US008052975B2

(12) United States Patent
Bhatia et al.

(10) Patent No.: US 8,052,975 B2
(45) Date of Patent: *Nov. 8, 2011

(54) COMPOUNDS AND METHODS FOR TREATMENT AND DIAGNOSIS OF CHLAMYDIAL INFECTION

(75) Inventors: Ajay Bhatia, Seattle, WA (US); Yasir A. W. Skeiky, Silver Spring, MD (US); Peter Probst, Seattle, WA (US)

(73) Assignee: Corixa Corporation, Seattle, WA (US)

( * ) Notice: Subject to any disclaimer, the term of this patent is extended or adjusted under 35 U.S.C. 154(b) by 345 days.

This patent is subject to a terminal disclaimer.

(21) Appl. No.: 11/929,665

(22) Filed: Oct. 30, 2007

(65) Prior Publication Data

US 2008/0299142 A1 Dec. 4, 2008

Related U.S. Application Data

(63) Continuation of application No. 10/872,155, filed on Jun. 18, 2004, now Pat. No. 7,462,357, which is a continuation of application No. 09/841,132, filed on Apr. 23, 2001, now abandoned.

(51) Int. Cl.
*A61K 39/00* (2006.01)
*A61K 39/38* (2006.01)
*A61K 39/02* (2006.01)
*A61K 39/118* (2006.01)
*A61K 45/00* (2006.01)
*A61K 38/00* (2006.01)
*C07K 14/00* (2006.01)
*C07K 16/00* (2006.01)
*C07K 17/00* (2006.01)
*C07K 2/00* (2006.01)
*C07K 4/00* (2006.01)
*C07K 5/00* (2006.01)
*C07K 7/00* (2006.01)
*C07K 1/00* (2006.01)

(52) U.S. Cl. ............... 424/190.1; 424/184.1; 424/185.1; 424/234.1; 424/263.1; 424/278.1; 530/300; 530/350

(58) Field of Classification Search ........................ None
See application file for complete search history.

(56) References Cited

U.S. PATENT DOCUMENTS

| | | | |
|---|---|---|---|
| 4,118,469 A | 10/1978 | Caldwell et al. ..................... 424/1 |
| 4,497,863 A | 2/1985 | Armstrong et al. ............ 436/510 |
| 4,497,899 A | 2/1985 | Armstrong et al. ............ 436/510 |
| 4,497,900 A | 2/1985 | Abram et al. .................... 436/511 |
| 5,166,053 A | 11/1992 | Huguenel et al. ............. 435/7.36 |
| 5,318,892 A | 6/1994 | Watanabe et al. ............. 435/7.36 |
| 5,539,084 A | 7/1996 | Geysen ........................... 530/334 |
| 5,629,167 A | 5/1997 | Ratti .............................. 435/7.36 |
| 5,725,863 A | 3/1998 | Daniels et al. .............. 424/263.1 |
| 5,725,963 A | 3/1998 | Daniels et al. .............. 424/263.1 |
| 5,750,110 A | 5/1998 | Prieels et al. ............... 424/208.1 |
| 5,785,973 A | 7/1998 | Bixler et al. ............. 424/196.11 |
| 5,869,608 A | 2/1999 | Caldwell et al. ............... 530/350 |
| 6,166,177 A * | 12/2000 | Probst et al. .................... 530/300 |
| 6,432,916 B1* | 8/2002 | Probst et al. ....................... 514/2 |
| 6,447,779 B1* | 9/2002 | Probst et al. ............... 424/190.1 |
| 6,448,234 B1* | 9/2002 | Fling ........................... 514/44 R |
| 6,555,115 B1* | 4/2003 | Probst et al. ............... 424/263.1 |
| 6,565,856 B1* | 5/2003 | Skeiky et al. ............... 424/263.1 |
| 6,899,880 B2* | 5/2005 | Stephens et al. ............ 424/190.1 |
| 6,919,187 B2* | 7/2005 | Bhatia et al. ................. 435/69.1 |
| 7,041,490 B1* | 5/2006 | Griffais et al. .............. 435/252.3 |
| 7,101,963 B2* | 9/2006 | Griffais et al. ................ 530/300 |
| 7,105,171 B2* | 9/2006 | Stephens et al. ............ 424/263.1 |
| 7,253,275 B2 | 8/2007 | Stephens et al. ............. 536/23.7 |
| 7,361,353 B2* | 4/2008 | Grandi et al. .............. 424/190.1 |
| 7,384,638 B2* | 6/2008 | Bhatia et al. ............... 424/192.1 |
| 7,459,524 B1* | 12/2008 | Jackson et al. ................ 530/350 |
| 7,462,357 B2* | 12/2008 | Bhatia et al. ............... 424/263.1 |
| 7,534,445 B2* | 5/2009 | Jackson et al. ............. 424/263.1 |
| 7,537,772 B1* | 5/2009 | Jackson ....................... 424/263.1 |
| 7,575,913 B2* | 8/2009 | Griffais et al. .............. 435/252.3 |
| 7,655,246 B2* | 2/2010 | Jackson et al. ............. 424/263.1 |
| 7,662,391 B2 | 2/2010 | Murdin et al. .............. 424/190.1 |
| 7,731,980 B2* | 6/2010 | Jackson ....................... 424/263.1 |
| 7,803,388 B2* | 9/2010 | Jackson ....................... 424/263.1 |
| 2002/0061848 A1* | 5/2002 | Bhatia et al. ...................... 514/12 |
| 2002/0146776 A1* | 10/2002 | Bhatia et al. .................. 435/69.3 |
| 2003/0175700 A1* | 9/2003 | Bhatia et al. ....................... 435/6 |
| 2004/0029129 A1* | 2/2004 | Wang et al. ......................... 435/6 |
| 2004/0131625 A1* | 7/2004 | Berthet et al. .............. 424/184.1 |

(Continued)

FOREIGN PATENT DOCUMENTS

EP 192 033 A2 8/1986

(Continued)

OTHER PUBLICATIONS

Read et al, Nucleic Acid Research, 2000, 28/6:1397-1406.*
Barth et al, General Meeting ASM, 2003, vol. 103, p. D-179 abstract only.*
Jen et al, General Meeting ASM, col. 101, p. 343, #E-67 abstract only.*
Thomson et al, Genome Research, 2008, 18:161-171.*
Carlson et al, Infection and Immunity, 2005, 73/10:6407-6418.*
Stephens et al, Science, Oct. 23, 1998, 282:754-759.*
Pannekoek et al, Drugs of TOday, 2006, 42/Suppl. A:65-73.*
Schnoor, JAVMA, Dec. 1, 1989, 195/11:1548-1561.*

(Continued)

*Primary Examiner* — Nita M Minnifield
(74) *Attorney, Agent, or Firm* — Seed IP Law Group PLLC

(57) ABSTRACT

Compounds and methods for the diagnosis and treatment of Chlamydial infection are disclosed. The compounds provided include polypeptides that contain at least one antigenic portion of a *Chlamydia* antigen and DNA sequences encoding such polypeptides. Pharmaceutical compositions and vaccines comprising such polypeptides or DNA sequences are also provided, together with antibodies directed against such polypeptides. Diagnostic kits containing such polypeptides or DNA sequences and a suitable detection reagent may be used for the detection of Chlamydial infection in patients and in biological samples.

29 Claims, 11 Drawing Sheets

U.S. PATENT DOCUMENTS

| | | | | |
|---|---|---|---|---|
| 2004/0137007 | A1* | 7/2004 | Bhatia et al. | 424/185.1 |
| 2004/0234536 | A1* | 11/2004 | Bhatia et al. | 424/184.1 |
| 2005/0065106 | A1 | 3/2005 | Murdin et al. | 514/44 |
| 2005/0084499 | A1* | 4/2005 | Bhatia et al. | 424/190.1 |
| 2005/0106162 | A1* | 5/2005 | Grandi et al. | 424/190.1 |
| 2005/0239160 | A1* | 10/2005 | Shaw et al. | 435/34 |
| 2005/0281847 | A1* | 12/2005 | Berthet et al. | 424/263.1 |
| 2006/0034871 | A1* | 2/2006 | Grandi et al. | 424/263.1 |
| 2006/0216308 | A1* | 9/2006 | Grandi et al. | 424/190.1 |
| 2006/0234260 | A1* | 10/2006 | Griffais et al. | 435/6 |
| 2008/0124338 | A1 | 5/2008 | Li et al. | 424/141.1 |
| 2008/0181918 | A1* | 7/2008 | Bhatia et al. | 424/263.1 |
| 2008/0213264 | A1* | 9/2008 | Bhatia et al. | 424/133.1 |
| 2008/0299142 | A1* | 12/2008 | Bhatia et al. | 424/190.1 |
| 2008/0317772 | A1* | 12/2008 | Bhatia et al. | 424/185.1 |
| 2009/0022755 | A1* | 1/2009 | Barth et al. | 424/190.1 |
| 2009/0028887 | A1* | 1/2009 | Bhatia et al. | 424/185.1 |
| 2009/0035296 | A1* | 2/2009 | Bhatia et al. | 424/130.1 |
| 2009/0047283 | A1* | 2/2009 | Bhatia et al. | 424/139.1 |
| 2009/0098165 | A1* | 4/2009 | Arulanandam et al. | 424/263.1 |
| 2010/0172927 | A1* | 7/2010 | Alderson et al. | 424/190.1 |
| 2010/0297164 | A1* | 11/2010 | Grandi et al. | 424/192.1 |

FOREIGN PATENT DOCUMENTS

| | | | |
|---|---|---|---|
| EP | 348725 | A2 | 1/1990 |
| EP | 784 059 | A1 | 7/1997 |
| JP | 11-123078 | A | 5/1999 |
| JP | 2002531129-A41 | * | 9/2002 |
| JP | 2003515343-A41 | * | 5/2003 |
| JP | 2004513622-A41 | * | 5/2004 |
| JP | 2004527480 | A2 * | 9/2004 |
| JP | 2005511076-A31 | * | 4/2005 |
| KR | 1020017000165-A67 | * | 6/2001 |
| KR | 1020027007135-A67 | * | 6/2002 |
| KR | 1020037000885-A67 | * | 1/2003 |
| WO | WO 94/06827 | | 3/1994 |
| WO | WO 96/31236 | | 10/1996 |
| WO | WO 97/06263 | | 2/1997 |
| WO | WO 98/02546 | | 1/1998 |
| WO | WO 98/10789 | | 3/1998 |
| WO | WO 98/28005 | | 7/1998 |
| WO | WO 99/17741 | | 4/1999 |
| WO | WO 99/27105 | | 6/1999 |
| WO | WO 99/28475 | A2 * | 6/1999 |
| WO | WO 99/51748 | | 10/1999 |
| WO | WO 00/26239 | A2 * | 5/2000 |
| WO | WO 00/27994 | | 5/2000 |
| WO | WO 00/34483 | A2 * | 6/2000 |
| WO | WO 00/37494 | | 6/2000 |
| WO | WO 00/46359 | | 8/2000 |
| WO | WO 00/55326 | | 9/2000 |
| WO | WO 00/66739 | | 11/2000 |
| WO | WO 01/21804 | | 3/2001 |
| WO | WO 01/21811 | | 3/2001 |
| WO | WO 01/23604 | | 4/2001 |
| WO | WO 01/35992 | A1 * | 5/2001 |
| WO | WO 01/40474 | A2 * | 6/2001 |
| WO | WO 01/40757 | A2 * | 6/2001 |
| WO | WO 01/46224 | | 6/2001 |
| WO | WO 01/81379 | | 11/2001 |
| WO | WO 01/81379 | A2 * | 11/2001 |
| WO | WO 02/02606 | | 1/2002 |
| WO | WO 02/08267 | A2 * | 1/2002 |
| WO | WO 02/062380 | A2 * | 8/2002 |
| WO | WO 02/077183 | A2 * | 10/2002 |
| WO | WO 02/079244 | A2 * | 10/2002 |
| WO | WO 01/85972 | | 11/2002 |
| WO | WO 03/041560 | A2 * | 5/2003 |
| WO | WO 03/049762 | A2 * | 6/2003 |
| WO | WO 03/049762-A62 | * | 6/2003 |
| WO | WO 2005/002619 | A2 * | 1/2005 |
| WO | WO 2006/045308 | * | 5/2006 |
| WO | WO 2006/104890 | A2 * | 10/2006 |
| WO | WO 2006/138004 | A2 * | 12/2006 |

OTHER PUBLICATIONS

Brunham et al, Infectious Agents and Disease, 1994, 3:218-233.*
Mygind et al, FEMS Microbiology Letters, 2000, 186:163-169.*
Baehr et al, PNAS, 1988, 85:4000-4004.*
Batteiger et al, Infection and Immunity, 1996, 64/2:542-547.*
Igietseme et al, Infection and Immunity, 2000, 68/12:6798-6806.*
Gervassi et al, J. Immunology, 2004, 173:6905-6913.*
Hickey et al, Current Molecular Medicine, 2005, 5:599-605.*
Fling et al, PNAS, 2001, 98/3:1160-1165.*
Stagg, Molecular Medicine Today, Apr. 1998, pp. 166-173.*
Maclean et al, Can. J. Microbiol., 1988, 34:141-147.*
Pal et al, Infection and Immunity, Aug. 1997, 65/8:3361-3369.*
Su et al, Vaccine, 1995, 13/11:1023-1032.*
Campos et al, Invest. Ophthalmol. Vis. Sci., Jul. 1995, 36/8:1477-1491 abstract only.*
Gupta et al, Vaccine, 1995, 13/14:1263-1276.*
Allen, J.E. et al., "An intermolecular mechanism of T cell halp for the production of antibodies to the bacterial pathogen, *Chlamydia trachomatis*," *Eur. J. Immunol.* 23: 1169-1172, 1993.
Attwood, T.K, (2000), "Genomics: The Babel of Bioinformatics," Science vol. 290, 471-473.
Baldridge et al., "Immunostimulatory activity of aminoalkyl glucosaminide 4-phosphates (AGPs): induction of protective innate immune responses by RC-524 and RC-529," J. Endotoxin Research 2002; 8(6); 453-8. PubMed Abstract Only, PMID: 12697089.
Bixler et al, In: Synthetic Vaccines, editor Ruth Arnon, 1987, pp. 39-71.
Bowie et al, Science, Mar. 16, 1990,247:1306-1310.
Brunham et al. L (2005) "Immunology of Chlamydia Infection: Iimplications for a *Chlamydia trachomatis* vaccine" Nature Reviews. Immunology, vol. 5, No. 2, 149-161.
Burgess et al, JCB, 1990, 111:2129-2138.
Chakrabarti et al., "Vaccinia virus expression vector: coexpression of β-galactosidase provides visual screening of recombinant virus plaques," Molecular and Cellular Biology 5(12):3403-3409, Dec. 1985.
Chothia, C. et al., "The relation between the divergence of sequence and structure in proteins," The EMBO Journal 5(4):823-826, 1986.
Conlan, J.W. et al., "Isolation of recombinant fragments of the major outer-membrane protein of *Chlamydia trachomatis*: their potential as subunit vaccines," Journal of General Microbiology 136: 2013-2020, 1990.
Creighton, In: Protein Structure a practical approach, 1989, pp. 184-186.
Creighton, In: Proteins, 1984, pp. 314-315.
Dalum et al, "Breakin of B Cell Tolerance Toward a Highly Conserved Self Protein," J. Immunol, 1996 157(11) 4796-4804.
Database Swiss-Prot, Accession No. O84883, Nov. 1, 1998.
Erlenbach, I. et al., "Single Amino Acid Substitutions and Deletions That Alter the G2 Protein Coupling Properties of the V2 Vasopressin Receptor Identified in Yeast by Receptor Random Mutagenesis," *The Journal of Biological Chemistry* 276(31):29382-29392, Aug. 3, 2001.
Earl et al., "Biological and immunological properties of human immunodeficiency virus type 1 envelope glycoprotein: analysis of proteins and truncations and deletions expressed by recombinant vaccinia viruses," Journal of Virology 65(1):31-41, Jan. 1991.
EMBL Database, Accession No. 084466, Jun. 1, 2003.
GenBank Accession No. AE001273, "Genome sequence of an obligate intracellular pathogen of humans: *Chlamydia trachomatis*," Oct. 30, 1999.
GenBank Accession No. AE001323, "Genome sequence of an obligate intracellular pathogen of humans: *Chlamydia trachomatis*," Oct. 30, 1999.
GenBank Accession No. AE001324, "Genome sequence of an obligate intracellular pathogen of humans: *Chlamydia trachomatis*," Oct. 30, 1999.
Genbank Accession No. AE001326, Oct. 30, 2000.
GenBank Accession No. AE001335, "Genome sequence of an obligate intracellular pathogen of humans: *Chlamydia trachomatis*," Oct. 30, 1999.
Genbank Accession No. AE001361, Jul. 22, 1998.
GenBank Accession No. E71500, "Genome sequence of an obligate intracellular pathogen of humans: *Chlamydia trachomatis*," Oct. 8, 1999.

GenBank Accession No. H71501, "Genome sequence of an obligate intracellular pathogen of humans: *Chlamydia trachomatis*," Oct. 8, 1999.
GenBank Accession No. H71510, "Genome sequence of an obligate intracellular pathogen of humans: *Chlamydia trachomatis*," Oct. 8, 1999.
GenBank Database, Accession No. AAC68226.1, Jul. 20, 1998.
GenBank Database, Accession No. AAK69391.2, Nov. 18, 2005.
GenBank Database, Accession No. AF268092.2, Nov. 18, 2005.
GenBank Database, Accession No. AAC68408.1, Jul. 20, 1998.
GenBank Database, Accession No. AAF39070.1, Mar. 7, 2000.
Genbank Database, Accession No. AE001316, Oct. 30, 2000.
Genbank Database, Accession No. AE001320, Oct. 30, 2000.
GenBank Database, Accession No. AE001333.1, Jul. 20, 1998.
GenBank Database, Accession No. AE001353.1, Jul. 20, 1998.
GenBank Database, Accession No. AE002286.2, Jun. 1, 2000.
GenBank Database, Accession No. AE002343.2, Jun. 1, 2000.
GenBank Database, Accession No. H71468.1, Oct. 26, 1995.
GenBank Database, Accession No. NC_000117, Dec. 9, 2002.
Geneseq Database (Derwent), Accession No. AAZ61507, Jun. 19, 2000.
Goh et al, Sexually Transmitted Infections, Jun. 1, 2006, 82/3:219-220.
Greenspan, N.S. et al., "Defining epitopes: It's not as easy as it seems," Nature Biotechnology 17:936-937, Oct. 1999.
Grimwood, J. et al., "Expression of *Chlamydia pneumoniae* Polymorphic Membrane Protein Family Genes," Infection and Immunity 69(4): 2383-2389, Apr. 2001.
Gu et al., "*Chlamydia trachomatis* RNA polymerase α subunit: sequence and structural analysis," J. Bacteriology 177:2594-2601, May 1995.
Hayes, L.J. et al., "*Chlamydia trachomatis* major outer membrane protein epitopes expressed as fusions with LamB in an attenuated aroA strain of *Salmonella typhimurium*; their application as potential immunogens," Journal of General Microbiology 137: 1557-1564, 1991.
Hayes, L.J. et al., "The major outer membrane proteins of *Chlamydia trachomatis* serovars A and B: intra-serovar amino acid changes do not alter specificities of serovar- and C subspecies-reactive antibody-binding domains," Journal of General Microbiology 136: 1559-1566, 1990.
Herbert et al (The Dictionary of Immunology, Academic Press, 3rd Edition, London, 1985, pp. 58-59).
Holmes, E.H., "PSMA specific antibodies and their diagnostic and therapeutic use," (Exp. Opin.Invest. Drugs, 2001, 10(3):511-519.
Houghten et al, In: Vaccines 86, editor Brown et al, 1986, pp. 21-25.
Janeway et al. Immunobiology: The Immune System in Health and Disease. 3rd Ed. 1997. pp. 7:7-7:10.
Jen et al, ASM 101.sup.st General Meeting, May 22, 2001, p. E-70 meeting abstract.
Jensen et al., "Infection of human and simian tissue cultures with rous sarcoma virus," Pro. Natl. Acad. Sci. USA 52:53-59, Jul. 1964.
Jobling, M.G. et al., "Analysis of structure and function of the B subunit of cholera toxin by the use of site-directed mutagenesis," Molecular Microbiology 5(7): 1755-1767, 1991.
Kalman, S. et al., "Comparative genomes of *Chlamydia pneumoniae* and *C. trachomatis*," Nature Genetics 21: 385-389, Apr. 1999.
Kim, S.-K. et al., "Induction of HLA Class I-Restricted CD8+ CTLs Specific for the Major Outer Membrane Protein of *Chlamydia trachomatis* in Human Genital Tract Infections," The Journal of Immunology 162: 6855-6866, 1999.
Knight, S.C. et al., "A peptide of *Chlamydia trachomatis* shown to be a primary T-cell epitope in vitro induces cell-mediated immunity in vivo," Immunology 85(1):8-15, May 1995.
Knudsen, K. et al., "Identification of Two Novel Genes Encoding 97- to 99-Kilodalton Outer Membrane Proteins of *Chlamydia pneumoniae*," Infection and Immunity 67(1): 375-383, Jan. 1999.
Kumar et al, PNAS USA, Feb. 1990, 87:1337-1341.
Kuon W. et al., "Recognition of Chlamydial Antigen by HLA-B27-Restricted Cytotoxic T Cells in HLA-B*2705 Transgenic CBA (H-2k) Mice," Arthritis & Rheumatism 40(5): 945-954, May 1997.
Lalvani et al., "Rapid effector function in CD8+ memory T cells," J. Exp. Med. 186(6):859-865, Sep. 15, 1997.

Lazar et al, Molecular and Cellular Biology, Mar. 1988, 8:1247-1252.
Lederman et al, Molecular Immunology 1991, 28:1171-1181.
Levinson and Jawetz, Medical Microbiology & Immunology, 3d ed., Appleton & Lange, 1994, pp. 292-293.
Li et al., "β-Endorphin omission analogs: Dissociation of immunoreactivity from other biological activities," Proc. Natl. Acad. Sci. USA, 1980, 77:3211-3214.
Lu, H. et al., "Interleukin-12 Production Is Required for Chlamydial Antigen-Pulsed Dendritic Cells to Induce Protection against Live *Chlamydia trachomatis* Infection," Infection and Immunity 67(4): 1763-1769, Apr. 1999.
Lu, Hang et al. (2002) "GM-CSF transgene-based adjuvant allows the establishment of protective mucosal immunity following vaccination with inactivated *Chlamydia trachomatis*." Journal of Immunology, vol. 169, No. 11, pp. 6324-6331.
Mikayama, T. et al., "Molecular cloning and functional expression of a cDNA encoding glycosylation-inhibiting factor," Proc. Natl. Acad. Sci. USA 90:10056-10060, Nov. 1993.
Murdin, A.D. et al., "A poliovirus Hybrid Expressing a Neutralization Epitope from the Major Outer Membrane Protein of *Chlamydia trachomatis* Is Highly Immunogenic," Infection and Immunity 61(10): 4406-4414, Oct. 1993.
Nosoh et al, Protein Stability and Stabilization Through Protein Engineering, 1991, pp. 197-217.
Pal et al. (2005) "Vaccination of newborn mice induces a strong protective immune response against respiratory and genital challenges with *Chlamydia trachomatis*" Vaccine, vol. 23, No. 46-47, pp. 5351-5358.
Pawlikowska, M. et al., "Adherence and ingesting capacity of peripheral blood granulocytes in rabbits immunized with various antigens of *Chlamydia* sp.," Central European Journal of Immunology 24: 293-298, 1999.
Peterson et al., "Characterization of the Murine Antibody Response to Peptides Representing the Variable Domains of the Major Outer Membrane Protein of *Chlamydia pneumonia*," Infection & Immunity 64/8: 3354-3359, 1996.
Peterson, E.M. et al., "The Effecto of Orientation Withing a Chimeric Peptide on the Immunogenicity of *Chlamydia trachomatis* Epitopes," Molecular Immunolgy 33(4/5): 335-339, 1996.
Rank et al., Infect. And Immunity, 58(8):2599-2605, 1990.
Rochlitz, C.F. et al., "Gene therapy of cancer," Swiss Medicine Weekly 131:4-9, 2001.
Roitt et al (Immunology, 1993, Mosby, St. Louis, p. 7.7-7.8).
Roitt et al, Immunobiology, Fourth Ed., 1996, Mosby, p. 7.9-7.11.
Rudinger, J., "Characteristics of the amino acids as components of a peptide hormone sequence," in Peptide Hormones, Parsons, J.A. (ed.), University Park Press, Baltimore, MD, Jun. 1976, pp. 1-5.
Rudinger, J., in Peptide Hormones, Parsons, J.A. (ed.), University Park Press, Baltimore, MD, Jun. 1976, pp. 5-7.
Sanderson et al., "Identification of a CD4.sup.+ T Cell-stimulating Antigen of Pathogenic Bacteria by Expression Cloning," J. Exp. Med. 182(6):1751-1757, 1995.
Scudiero et al., "Evaluation of a soluble tetrazolium/formazan assay for cell growth and drug sensitivity in culture using human and other tumor cell lines," Cancer Research 48:4827-4833, Sep. 1, 1988.
Shirai, M. et al., "Comparison of whole genome sequences of *Chlamydia pneumoniae* J138 from Japan and CWL029 from USA," Nucleic Acids Research 28(12): 2311-2314, 2000.
Starnbach et al., "Protective cytotoxic T lymphocytes are induced during murine infection with *Chlamydia trachomatis*," The Journal of Immunology 153(11):5183-5189, Dec. 1, 1994.
Su, H. et al., "Immunogenicity of a synthetic oligopeptide corresponding to antigenically common T-helper and B-cell neutralizing epitopes of the major outer membrane protein of *Chlamydia tracomatis*," Vaccine 11(11): 1159-1166, 1993.
Swiss-Prot Database, Accession No. 084267, Nov. 1, 1998.
Unanue, E.R., "Chemical Features of Peptide Selection by the Class II Histocompatibility Molecules," American Journal of Pathology 154(3): 651-664, Mar. 1999.
Van de Loo et al., "An oleate 12-hydroxylase from *Ricinus communis* L. is a fatty acyl desaturase homolog," Proc. Natl. Acad. Sci 92 6743-6747 1995.

Vile, R.G. et al., "Cancer gene therapy: hard lessons and new courses," Gene Therapy 7:2-8, 2000.

Webb et al., "Molecular cloning of a novel protein antigen of *Leishmania major* that elicits a potent immune response in experimental murine leishmaniasis," The Journal of Immunology 157:5034-5041, 1996.

Yasuda, K. et al., "Serine 6 of Lck Tyrosine Kinase: A Critical Site for Lck Myristoylation, Membrane Localization, and Function in T Lymphocytes," The Journal of Immunology 165: 3226-3231, 2000.

Zhang, D. et al., "DNA vaccination with the major outer-membrane protein gene induces acquired immunity to *Chlamydia trachomatis* (mouse pneumonitis) infection," J. Infect. Dis. 176(4): 1035-1040, Oct. 1997.

Zhong, G. et al., "Conformational Mimicry of a Chlamydial Neutralization Epitope on Filamentous Phage," The Journal of Biological Chemistry 269(39): 24183-24188, Sep. 30, 1994.

Zhong, G. et al., "Immunogenicity Evaluation of a Lipidic Amino-Acid-Based Synthetic Peptide Vaccine for *Chlamydia trachomatis*," The Journal of Immunology 151(7): 3728-3736, Oct. 1, 1993.

Zhong, G. et al., "Identification of a Chlamydial Protease-like Activity Factor Responsible for the Degradation of Host Transcription Factors," *J. Exp. Med.* 193(8):935-942, 2001.

Zhong, G. et al., "Mapping epitopes of neutralizing monoclonal antibodies using phage random peptide libraries," Journal of Industrial Microbiology & Biotechnology 19: 71-76, 1997.

* cited by examiner

Retroviral vector
pBIB-KS —[LTR]—[KS-MCS|IRES-Blasto^r]—[LTR]—

```
        Kozak-Start
GA TCT GCC GCC ACC ATG GAA TTC GAT ATC GGA TCC CTG CAG
   A   CGG CGG TGG TAC CTT AAG CTA TAG CCT AGG GAC GTC
(BglII)                EcoRI         BamHI   PstI
                                                      ReadingFrame 1
AAG CTT GAG CTC GAG CGC GGC CGC TAA TTA GCT GAG              KS1+
TTC GAA CTC GAG CTC GCG CCG GCG ATT AAT CGA CTC AGC T
HinDIII     XhoI        NotI   Stop Stop Stop (SalI)

Kozak-Start
GA TCT GCC GCC ACC ATG GGA ATT CGA TAT CGG ATC CTG CA G
   A   CGG CGG TGG TAC CCT TAA GCT ATA GCC TAG GAC GT C
(BglII)                EcoRI         BamHI   PstI
                                                      ReadingFrame 1
AA GCT TGA GCT CGA GCG CGG CCG CTA ATT AGC TGA G              KS2+
TT CGA ACT CGA GCT CGC GCC GGC GAT TAA TCG ACT CAG CT
HinDIII     XhoI        NotI   Stop Stop Stop (SalI)

Kozak-Start
GA TCT GCC GCC ACC ATG GGG AAT TCG ATA TCG GAT CCC TGC AG
   A   CGG CGG TGG TAC CCC TTA AGC TAT AGC CTA GGG ACG TC
(BglII)                EcoRI         BamHI   PstI
                                                      ReadingFrame 3
A AGC TTG AGC TCG AGC GCG GCC GCT AAT TAG CTG AG              KS3+
T TCG AAC TCG AGC TCG CGC CGG CGA TTA ATC GAC TCA GCT
HinDIII     XhoI        NotI   Stop Stop Stop (SalI)
```

*Fig. 2*

CP SWIB Nde (5' primer)
5' GATATACATATGCATCACCATCACCATCACATGAGTCAAAAAAATAAAAACTCT CP SWIB EcoRI (3' primer)
5' CTCGAGGAATTCTTATTTTACAATATGTTTGGA CP S13 Nde (5' primer)
5' GATATACATATGCATCACCATCACCATCACATGCCACGCATCATTGGAATGAT CP S13 EcoRI (3' primer)
5' CTCGAGGAATTCTTATTTCTTCTTACCTGC

*Fig. 6*

COMPOUNDS AND METHODS FOR TREATMENT AND DIAGNOSIS OF CHLAMYDIAL INFECTION

CROSS-REFERENCE TO RELATED APPLICATIONS

This application is a continuation of U.S. patent application Ser. No. 10/872,155 filed Jun. 18, 2004 (now U.S. Pat. No. 7,462,357); which is a continuation of U.S. patent application Ser. No. 09/841,132 filed Apr. 23, 2001 (now abandoned), which applications are incorporated herein by reference in their entireties.

STATEMENT REGARDING SEQUENCE LISTING

The Sequence Listing associated with this application is provided in text format in lieu of a paper copy, and is hereby incorporated by reference into the specification. The name of the text file containing the Sequence Listing is 21012_469C15a SEQUENCE_LISTING.txt. The text file is 1122 KB, was created on Mar. 10, 2010, and is being submitted electronically EFS-Web.

TECHNICAL FIELD

The present invention relates generally to the detection and treatment of Chlamydial infection. In particular, the invention is related to polypeptides comprising a *Chlamydia* antigen and the use of such polypeptides for the serodiagnosis and treatment of Chlamydial infection.

BACKGROUND OF THE INVENTION

Chlamydiae are intracellular bacterial pathogens that are responsible for a wide variety of important human and animal infections. *Chlamydia trachomatis* is one of the most common causes of sexually transmitted diseases and can lead to pelvic inflammatory disease (PID), resulting in tubal obstruction and infertility. *Chlamydia trachomatis* may also play a role in male infertility. In 1990, the cost of treating PID in the US was estimated to be $4 billion. Trachoma, due to ocular infection with *Chlamydia trachomatis*, is the leading cause of preventable blindness worldwide. *Chlamydia pneumonia* is a major cause of acute respiratory tract infections in humans and is also believed to play a role in the pathogenesis of atherosclerosis and, in particular, coronary heart disease. Individuals with a high titer of antibodies to *Chlamydia pneumonia* have been shown to be at least twice as likely to suffer from coronary heart disease as seronegative individuals. Chlamydial infections thus constitute a significant health problem both in the US and worldwide.

Chlamydial infection is often asymptomatic. For example, by the time a woman seeks medical attention for PID, irreversible damage may have already occurred resulting in infertility. There thus remains a need in the art for improved vaccines and pharmaceutical compositions for the prevention and treatment of *Chlamydia* infections. The present invention fulfills this need and further provides other related advantages.

SUMMARY OF THE INVENTION

The present invention provides compositions and methods for the diagnosis and therapy of *Chlamydia* infection. In one aspect, the present invention provides polypeptides comprising an immunogenic portion of a *Chlamydia* antigen, or a variant of such an antigen. Certain portions and other variants are immunogenic, such that the ability of the variant to react with antigen-specific antisera is not substantially diminished. Within certain embodiments, the polypeptide comprises an amino acid sequence encoded by a polynucleotide sequence selected from the group consisting of (a) a sequence of SEQ ID NO: 358-361; (b) the complements of said sequences; and (c) sequences that hybridize to a sequence of (a) or (b) under moderate to highly stringent conditions. In specific embodiments, the polypeptides of the present invention comprise at least a portion of a Chlamydial protein that includes an amino acid sequence selected from the group consisting of sequences recited in SEQ ID NO:362-365 and variants thereof.

The present invention further provides polynucleotides that encode a polypeptide as described above, or a portion thereof (such as a portion encoding at least 15 amino acid residues of a Chlamydial protein), expression vectors comprising such polynucleotides and host cells transformed or transfected with such expression vectors.

In a related aspect, polynucleotide sequences encoding the above polypeptides, recombinant expression vectors comprising one or more of these polynucleotide sequences and host cells transformed or transfected with such expression vectors are also provided.

In another aspect, the present invention provides fusion proteins comprising an inventive polypeptide, or, alternatively, an inventive polypeptide and a known *Chlamydia* antigen, as well as polynucleotides encoding such fusion proteins, in combination with a physiologically acceptable carrier or immunostimulant for use as pharmaceutical compositions and vaccines thereof.

The present invention further provides pharmaceutical compositions that comprise: (a) an antibody, both polyclonal and monoclonal, or antigen-binding fragment thereof that specifically binds to a Chlamydial protein; and (b) a physiologically acceptable carrier. Within other aspects, the present invention provides pharmaceutical compositions that comprise one or more *Chlamydia* polypeptides disclosed herein, e.g., a polypeptide according to SEQ ID NO:362-365, 431-454 and 560-581, or a polynucleotide molecule encoding such a polypeptide, such as a polynucleotide according to SEQ ID NO:358-361, 407-430, 525-559 and 582-598, and a physiologically acceptable carrier. The invention also provides vaccines for prophylactic and therapeutic purposes comprising one or more of the disclosed polypeptides and an immunostimulant, as defined herein, together with vaccines comprising one or more polynucleotide sequences encoding such polypeptides and an immunostimulant.

In yet another aspect, methods are provided for inducing protective immunity in a patient, comprising administering to a patient an effective amount of one or more of the above pharmaceutical compositions or vaccines.

In yet a further aspect, methods for the treatment of *Chlamydia* infection in a patient are provided, the methods comprising obtaining peripheral blood mononuclear cells (PBMC) from the patient, incubating the PBMC with a polypeptide of the present invention (or a polynucleotide that encodes such a polypeptide) to provide incubated T cells and administering the incubated T cells to the patient. The present invention additionally provides methods for the treatment of *Chlamydia* infection that comprise incubating antigen presenting cells with a polypeptide of the present invention (or a polynucleotide that encodes such a polypeptide) to provide incubated antigen presenting cells and administering the incubated antigen presenting cells to the patient. Proliferated cells may, but need not, be cloned prior to administration to the patient. In certain embodiments, the antigen presenting cells are selected from the group consisting of dendritic cells, macrophages, monocytes, B-cells, and fibroblasts. Compositions for the treatment of *Chlamydia* infection comprising T cells or antigen presenting cells that have been incubated with a polypeptide or polynucleotide of the present invention are also provided. Within related aspects, vaccines are provided that comprise: (a) an antigen presenting cell that expresses a polypeptide as described above and (b) an immunostimulant.

The present invention further provides, within other aspects, methods for removing Chlamydial-infected cells from a biological sample, comprising contacting a biological sample with T cells that specifically react with a Chlamydial protein, wherein the step of contacting is performed under conditions and for a time sufficient to permit the removal of cells expressing the protein from the sample.

Within related aspects, methods are provided for inhibiting the development of Chlamydial infection in a patient, comprising administering to a patient a biological sample treated as described above. In further aspects of the subject invention, methods and diagnostic kits are provided for detecting *Chlamydia* infection in a patient. In one embodiment, the method comprises: (a) contacting a biological sample with at least one of the polypeptides or fusion proteins disclosed herein; and (b) detecting in the sample the presence of binding agents that bind to the polypeptide or fusion protein, thereby detecting *Chlamydia* infection in the biological sample. Suitable biological samples include whole blood, sputum, serum, plasma, saliva, cerebrospinal fluid and urine. In one embodiment, the diagnostic kits comprise one or more of the polypeptides or fusion proteins disclosed herein in combination with a detection reagent. In yet another embodiment, the diagnostic kits comprise either a monoclonal antibody or a polyclonal antibody that binds with a polypeptide of the present invention.

The present invention also provides methods for detecting *Chlamydia* infection comprising: (a) obtaining a biological sample from a patient; (b) contacting the sample with at least two oligonucleotide primers in a polymerase chain reaction, at least one of the oligonucleotide primers being specific for a polynucleotide sequence disclosed herein; and (c) detecting in the sample a polynucleotide sequence that amplifies in the presence of the oligonucleotide primers. In one embodiment, the oligonucleotide primer comprises at least about 10 contiguous nucleotides of a polynucleotide sequence peptide disclosed herein, or of a sequence that hybridizes thereto.

In a further aspect, the present invention provides a method for detecting *Chlamydia* infection in a patient comprising: (a) obtaining a biological sample from the patient; (b) contacting the sample with an oligonucleotide probe specific for a polynucleotide sequence disclosed herein; and (c) detecting in the sample a polynucleotide sequence that hybridizes to the oligonucleotide probe. In one embodiment, the oligonucleotide probe comprises at least about 15 contiguous nucleotides of a polynucleotide sequence disclosed herein, or a sequence that hybridizes thereto.

These and other aspects of the present invention will become apparent upon reference to the following detailed description.

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

Sequence Identifiers

SEQ ID NO: 1 is the determined DNA sequence for the *C. trachomatis* clone 1-B1-66.

SEQ ID NO: 2 is the determined DNA sequence for the *C. trachomatis* clone 4-D7-28.

SEQ ID NO: 3 is the determined DNA sequence for the *C. trachomatis* clone 3-G3-10.

SEQ ID NO: 4 is the determined DNA sequence for the *C. trachomatis* clone 10-C10-31.

SEQ ID NO: 5 is the predicted amino acid sequence for 1-B1-66.

SEQ ID NO: 6 is the predicted amino acid sequence for 4-D7-28.

SEQ ID NO: 7 is a first predicted amino acid sequence for 3-G3-10.

SEQ ID NO: 8 is a second predicted amino acid sequence for 3-G3-10.

SEQ ID NO: 9 is a third predicted amino acid sequence for 3-G3-10.

SEQ ID NO: 10 is a fourth predicted amino acid sequence for 3-G3-10.

SEQ ID NO: 11 is a fifth predicted amino acid sequence for 3-G3-10.

SEQ ID NO: 12 is the predicted amino acid sequence for 10-C10-31.

SEQ ID NO: 13 is the amino acid sequence of the synthetic peptide 1-B1-66/48-67.

SEQ ID NO: 14 is the amino acid sequence of the synthetic peptide 1-B1-66/58-77.

SEQ ID NO: 15 is the determined DNA sequence for the *C. trachomatis* serovar LGV II clone 2C7-8

SEQ ID NO: 16 is a DNA sequence of a putative open reading frame from a region of the *C. trachomatis* serovar D genome to which 2C7-8 maps SEQ ID NO: 17 is the predicted amino acid sequence encoded by the DNA sequence of SEQ ID NO: 16

SEQ ID NO: 18 is the amino acid sequence of the synthetic peptide CtC7.8-12

SEQ ID NO: 19 is the amino acid sequence of the synthetic peptide CtC7.8-13

SEQ ID NO: 20 is the predicted amino acid sequence encoded by a second putative open reading from *C. trachomatis* serovar D SEQ ID NO: 21 is the determined DNA sequence for clone 4C9-18 from *C. trachomatis* LGV II SEQ ID NO: 22 is the determined DNA sequence homologous to Lipoamide Dehydrogenase from *C. trachomatis* LGV II SEQ ID NO: 23 is the determined DNA sequence homologous to Hypothetical protein from *C. trachomatis* LGV II SEQ ID NO: 24 is the determined DNA sequence homologous to Ubiquinone Methyltransferase from *C. trachomatis* LGV II SEQ ID NO: 25 is the determined DNA sequence for clone 4C9-18#2 BL21 pLysS from *C. trachomatis* LGV II SEQ ID NO: 26 is the predicted amino acid sequence for 4C9-18#2 from *C. trachomatis* LGV II SEQ ID NO: 27 is the determined DNA sequence for Cp-SWIB from *C. pneumonia* strain TWAR SEQ ID NO: 28 is the predicted amino acid sequence for Cp-SWIB from *C. pneumonia* strain TWAR SEQ ID NO: 29 is the determined DNA sequence for Cp-S13 (CT509) from *C. pneumonia* strain TWAR SEQ ID NO: 30 is the predicted amino acid sequence for Cp-S13 from *C. pneumonia* strain TWAR SEQ ID NO: 31 is the amino acid sequence for a 10mer consensus peptide from CtC7.8-12 and CtC7.8-13

SEQ ID NO: 32 is the predicted amino acid sequence for clone 2C7-8 from *C. trachomatis* LGV II SEQ ID NO: 33 is the DNA sequence corresponding to nucleotides 597304-597145 of the *C. trachomatis* serovar D genome (NCBI, BLASTN search), which shows homology to clone 2C7-8

SEQ ID NO: 34 is the predicted amino acid sequence encoded by the sequence of SEQ ID NO: 33

SEQ ID NO: 35 is the DNA sequence for C.p. SWIB Nde (5' primer) from *C. pneumonia*

SEQ ID NO: 36 is the DNA sequence for C.p. SWIB EcoRI (3' primer) from *C. pneumonia*

SEQ ID NO: 37 is the DNA sequence for C.p. S13 Nde (5' primer) from *C. pneumonia*

SEQ ID NO: 38 is the DNA sequence for C.p. S13 EcoRI (3' primer) from *C. pneumonia*

SEQ ID NO: 39 is the amino acid sequence for CtSwib 52-67 peptide from *C. trachomatis* LGV II SEQ ID NO: 40 is the amino acid sequence for CpSwib 53-68 peptide from *C. pneumonia*

SEQ ID NO: 41 is the amino acid sequence for HuSwib 288-302 peptide from Human SWI domain SEQ ID NO: 42 is the amino acid sequence for CtSWI-T 822-837 peptide from the topoisomerase-SWIB fusion of *C. trachomatis*

SEQ ID NO: 43 is the amino acid sequence for CpSWI-T 828-842 peptide from the topoisomerase-SWIB fusion of *C. pneumonia*

SEQ ID NO: 44 is a first determined DNA sequence for the *C. trachomatis* LGV II clone 19783.3.jen.seq(1>509) CTL2#11-3', representing the 3' end.

SEQ ID NO: 45 is a second determined DNA sequence for the *C. trachomatis* LGV II clone 19783.4.jen.seq(1>481) CTL2#11-5', representing the 5' end.

SEQ ID NO: 46 is the determined DNA sequence for the *C. trachomatis* LGV II clone 19784CTL2__12consensus.seq (1>427)CTL2#12.

SEQ ID NO: 47 is the determined DNA sequence for the *C. trachomatis* LGV II clone 19785.4.jen.seq(1>600)CTL2#16-5', representing the 5' end.

SEQ ID NO: 48 is a first determined DNA sequence for the *C. trachomatis* LGV II clone 19786.3.jen.seq(1>600) CTL2#18-3', representing the 3' end.

SEQ ID NO: 49 is a second determined DNA sequence for the *C. trachomatis* LGV II clone 19786.4.jen.seq(1>600) CTL2#18-5', representing the 5' end.

SEQ ID NO: 50 is the determined DNA sequence for the *C. trachomatis* LGV II clone 19788CTL2__21consensus.seq (1>406)CTL2#21.

SEQ ID NO: 51 is the determined DNA sequence for the *C. trachomatis* LGV II clone 19790CTL2__23consensus.seq (1>602)CTL2#23.

SEQ ID NO: 52 is the determined DNA sequence for the *C. trachomatis* LGV II clone 19791CTL2__24consensus.seq (1>145)CTL2#24.

SEQ ID NO: 53 is the determined DNA sequence for the *C. trachomatis* LGV II clone CTL2#4.

SEQ ID NO: 54 is the determined DNA sequence for the *C. trachomatis* LGV II clone CTL2#8b.

SEQ ID NO: 55 is the determined DNA sequence for the *C. trachomatis* LGV II clone 15-G1-89, sharing homology to the lipoamide dehydrogenase gene CT557.

SEQ ID NO: 56 is the determined DNA sequence for the *C. trachomatis* LGV II clone 14-H1-4, sharing homology to the thiol specific antioxidant gene CT603.

SEQ ID NO: 57 is the determined DNA sequence for the *C. trachomatis* LGV II clone 12-G3-83, sharing homology to the hypothetical protein CT622.

SEQ ID NO: 58 is the determined DNA sequence for the *C. trachomatis* LGV II clone 12-B3-95, sharing homology to the lipoamide dehydrogenase gene CT557.

SEQ ID NO: 59 is the determined DNA sequence for the *C. trachomatis* LGV II clone 11-H4-28, sharing homology to the dnaK gene CT396.

SEQ ID NO: 60 is the determined DNA sequence for the *C. trachomatis* LGV II clone 11-H3-68, sharing partial homology to the PGP6-D virulence protein and L1 ribosomal gene CT318.

SEQ ID NO: 61 is the determined DNA sequence for the *C. trachomatis* LGV II clone 11-G1-34, sharing partial homology to the malate dehydrogenase gene CT376 and to the glycogen hydrolase gene CT042.

SEQ ID NO: 62 is the determined DNA sequence for the *C. trachomatis* LGV II clone 11-G10-46, sharing homology to the hypothetical protein CT610.

SEQ ID NO: 63 is the determined DNA sequence for the *C. trachomatis* LGV II clone 11-C12-91, sharing homology to the OMP2 gene CT443.

SEQ ID NO: 64 is the determined DNA sequence for the *C. trachomatis* LGV II clone 11-A3-93, sharing homology to the HAD superfamily gene CT103.

SEQ ID NO: 65 is the determined amino acid sequence for the *C. trachomatis* LGV II clone 14-H1-4, sharing homology to the thiol specific antioxidant gene CT603.

SEQ ID NO: 66 is the determined DNA sequence for the *C. trachomatis* LGV II clone CtL2#9.

SEQ ID NO: 67 is the determined DNA sequence for the *C. trachomatis* LGV II clone CtL2#7.

SEQ ID NO: 68 is the determined DNA sequence for the *C. trachomatis* LGV II clone CtL2#6.

SEQ ID NO: 69 is the determined DNA sequence for the *C. trachomatis* LGV II clone CtL2#5.

SEQ ID NO: 70 is the determined DNA sequence for the *C. trachomatis* LGV II clone CtL2#2.

SEQ ID NO: 71 is the determined DNA sequence for the *C. trachomatis* LGV II clone CtL2#1.

SEQ ID NO: 72 is a first determined DNA sequence for the *C. trachomatis* LGV II clone 23509.2CtL2#3-5', representing the 5' end.

SEQ ID NO: 73 is a second determined DNA sequence for the *C. trachomatis* LGV II clone 23509.1CtL2#3-3', representing the 3' end.

SEQ ID NO: 74 is a first determined DNA sequence for the *C. trachomatis* LGV II clone 22121.2CtL2#10-5', representing the 5' end.

SEQ ID NO: 75 is a second determined DNA sequence for the *C. trachomatis* LGV II clone 22121.1 CtL2#10-3', representing the 3' end.

SEQ ID NO: 76 is the determined DNA sequence for the *C. trachomatis* LGV II clone 19787.6CtL2#19-5', representing the 5' end.

SEQ ID NO: 77 is the determined DNA sequence for the *C. pneumoniae* LGV II clone CpS13-His.

SEQ ID NO: 78 is the determined DNA sequence for the *C. pneumoniae* LGV II clone Cp_SWIB-His.

SEQ ID NO: 79 is the determined DNA sequence for the *C. trachomatis* LGV II clone 23-G7-68, sharing partial homology to the L11, L10 and L1 ribosomal protein.

SEQ ID NO: 80 is the determined DNA sequence for the *C. trachomatis* LGV II clone 22-F8-91, sharing homology to the pmpC gene.

SEQ ID NO: 81 is the determined DNA sequence for the *C. trachomatis* LGV II clone 21-E8-95, sharing homology to the CT610-CT613 genes.

SEQ ID NO: 82 is the determined DNA sequence for the *C. trachomatis* LGV II clone 19-F12-57, sharing homology to the CT858 and recA genes.

SEQ ID NO: 83 is the determined DNA sequence for the *C. trachomatis* LGV II clone 19-F12-53, sharing homology to the CT445 gene encoding glutamyl tRNA synthetase.

SEQ ID NO: 84 is the determined DNA sequence for the *C. trachomatis* LGV II clone 19-A5-54, sharing homology to the cryptic plasmid gene.

SEQ ID NO: 85 is the determined DNA sequence for the *C. trachomatis* LGV II clone 17-E11-72, sharing partial homology to the OppC_2 and pmpD genes.

SEQ ID NO: 86 is the determined DNA sequence for the *C. trachomatis* LGV II clone 17-C1-77, sharing partial homology to the CT857 and CT858 open reading frames.

SEQ ID NO: 87 is the determined DNA sequence for the *C. trachomatis* LGV II clone 15-H2-76, sharing partial homology to the pmpD and SycE genes, and to the CT089 ORF.

SEQ ID NO: 88 is the determined DNA sequence for the *C. trachomatis* LGV II clone 15-A3-26, sharing homology to the CT858 ORF.

SEQ ID NO: 89 is the determined amino acid sequence for the *C. pnuemoniae* clone Cp_SWIB-His.

SEQ ID NO: 90 is the determined amino acid sequence for the *C. trachomatis* LGV II clone CtL2_LPDA_FL.

SEQ ID NO: 91 is the determined amino acid sequence for the *C. pnuemoniae* clone CpS13-His.

SEQ ID NO: 92 is the determined amino acid sequence for the *C. trachomatis* LGV II clone CtL2_TSA_FL.

SEQ ID NO: 93 is the amino acid sequence for Ct-Swib 43-61 peptide from *C. trachomatis* LGV II.

SEQ ID NO: 94 is the amino acid sequence for Ct-Swib 48-67 peptide from *C. trachomatis* LGV II.

SEQ ID NO: 95 is the amino acid sequence for Ct-Swib 52-71 peptide from *C. trachomatis* LGV II.

SEQ ID NO: 96 is the amino acid sequence for Ct-Swib 58-77 peptide from *C. trachomatis* LGV II.

SEQ ID NO: 97 is the amino acid sequence for Ct-Swib 63-82 peptide from *C. trachomatis* LGV II.

SEQ ID NO: 98 is the amino acid sequence for Ct-Swib 51-66 peptide from *C. trachomatis* LGV II.

SEQ ID NO: 99 is the amino acid sequence for Cp-Swib 52-67 peptide from *C. pneumonia*.

SEQ ID NO: 100 is the amino acid sequence for Cp-Swib 37-51 peptide from *C. pneumonia*.

SEQ ID NO: 101 is the amino acid sequence for Cp-Swib 32-51 peptide from *C. pneumonia*.

SEQ ID NO: 102 is the amino acid sequence for Cp-Swib 37-56 peptide from *C. pneumonia*.

SEQ ID NO: 103 is the amino acid sequence for Ct-Swib 36-50 peptide from *C. trachomatis*.

SEQ ID NO: 104 is the amino acid sequence for Ct-S13 46-65 peptide from *C. trachomatis*.

SEQ ID NO: 105 is the amino acid sequence for Ct-S13 60-80 peptide from *C. trachomatis*.

SEQ ID NO: 106 is the amino acid sequence for Ct-S13 1-20 peptide from *C. trachomatis*.

SEQ ID NO: 107 is the amino acid sequence for Ct-S13 46-65 peptide from *C. trachomatis*.

SEQ ID NO: 108 is the amino acid sequence for Ct-S13 56-75 peptide from *C. trachomatis*.

SEQ ID NO: 109 is the amino acid sequence for Cp-S13 56-75 peptide from *C. pneumoniae*.

SEQ ID NO: 110 is the determined DNA sequence for the *C. trachomatis* LGV II clone 21-G12-60, containing partial open reading frames for hypothetical proteins CT875, CT229 and CT228.

SEQ ID NO: 111 is the determined DNA sequence for the *C. trachomatis* LGV II clone 22-B3-53, sharing homology to the CT110 ORF of GroEL.

SEQ ID NO: 112 is the determined DNA sequence for the *C. trachomatis* LGV II clone 22-A1-49, sharing partial homology to the CT660 and CT659 ORFs.

SEQ ID NO: 113 is the determined DNA sequence for the *C. trachomatis* LGV II clone 17-E2-9, sharing partial homology to the CT611 and CT 610 ORFs.

SEQ ID NO: 114 is the determined DNA sequence for the *C. trachomatis* LGV II clone 17-C10-31, sharing partial homology to the CT858 ORF.

SEQ ID NO: 115 is the determined DNA sequence for the *C. trachomatis* LGV II clone 21-C7-8, sharing homology to the dnaK-like gene.

SEQ ID NO: 116 is the determined DNA sequence for the *C. trachomatis* LGV II clone 20-G3-45, containing part of the pmpB gene CT413.

SEQ ID NO: 117 is the determined DNA sequence for the *C. trachomatis* LGV II clone 18-C5-2, sharing homology to the S1 ribosomal protein ORF.

SEQ ID NO: 118 is the determined DNA sequence for the *C. trachomatis* LGV II clone 17-C5-19, containing part of the ORFs for CT431 and CT430.

SEQ ID NO: 119 is the determined DNA sequence for the *C. trachomatis* LGV II clone 16-D4-22, contains partial sequences of ORF3 and ORF4 of the plasmid for growth within mammalian cells.

SEQ ID NO: 120 is the determined full-length DNA sequence for the *C. trachomatis* serovar LGV II Cap1 gene CT529.

SEQ ID NO: 121 is the predicted full-length amino acid sequence for the *C. trachomatis* serovar LGV II Cap 1 gene CT529.

SEQ ID NO: 122 is the determined full-length DNA sequence for the *C. trachomatis* serovar E Cap 1 gene CT529.

SEQ ID NO: 123 is the predicted full-length amino acid sequence for the *C. trachomatis* serovar E Cap 1 gene CT529.

SEQ ID NO: 124 is the determined full-length DNA sequence for the *C. trachomatis* serovar 1A Cap 1 gene CT529.

SEQ ID NO: 125 is the predicted full-length amino acid sequence for the *C. trachomatis* serovar 1A Cap 1 gene CT529.

SEQ ID NO: 126 is the determined full-length DNA sequence for the *C. trachomatis* serovar G Cap 1 gene CT529.

SEQ ID NO: 127 is the predicted full-length amino acid sequence for the *C. trachomatis* serovar G Cap 1 gene CT529.

SEQ ID NO: 128 is the determined full-length DNA sequence for the *C. trachomatis* serovar F1 NII Cap 1 gene CT529.

SEQ ID NO: 129 is the predicted full-length amino acid sequence for the *C. trachomatis* serovar F1 NII Cap 1 gene CT529.

SEQ ID NO: 130 is the determined full-length DNA sequence for the *C. trachomatis* serovar L1 Cap1 gene CT529.

SEQ ID NO: 131 is the predicted full-length amino acid sequence for the *C. trachomatis* serovar L1 Cap1 gene CT529.

SEQ ID NO: 132 is the determined full-length DNA sequence for the *C. trachomatis* serovar L3 Cap 1 gene CT529.

SEQ ID NO: 133 is the predicted full-length amino acid sequence for the C. trachomatis serovar L3 Cap 1 gene CT529.

SEQ ID NO: 134 is the determined full-length DNA sequence for the C. trachomatis serovar Ba Cap 1 gene CT529.

SEQ ID NO: 135 is the predicted full-length amino acid sequence for the C. trachomatis serovar Ba Cap1 gene CT529.

SEQ ID NO: 136 is the determined full-length DNA sequence for the C. trachomatis serovar MOPN Cap 1 gene CT529.

SEQ ID NO: 137 is the predicted full-length amino acid sequence for the C. trachomatis serovar MOPN Cap 1 gene CT529.

SEQ ID NO: 138 is the determined amino acid sequence for the Cap 1 CT529 ORF peptide #124-139 of C. trachomatis serovar L2.

SEQ ID NO: 139 is the determined amino acid sequence for the Cap 1 CT529 ORF peptide #132-147 of C. trachomatis serovar L2.

SEQ ID NO: 140 is the determined amino acid sequence for the Cap 1 CT529 ORF peptide #138-155 of C. trachomatis serovar L2.

SEQ ID NO: 141 is the determined amino acid sequence for the Cap 1 CT529 ORF peptide #146-163 of C. trachomatis serovar L2.

SEQ ID NO: 142 is the determined amino acid sequence for the Cap 1 CT529 ORF peptide #154-171 of C. trachomatis serovar L2.

SEQ ID NO: 143 is the determined amino acid sequence for the Cap 1 CT529 ORF peptide #162-178 of C. trachomatis serovar L2.

SEQ ID NO: 144 is the determined amino acid sequence for the Cap 1 CT529 ORF peptide #138-147 of C. trachomatis serovar L2.

SEQ ID NO: 145 is the determined amino acid sequence for the Cap 1 CT529 ORF peptide #139-147 of C. trachomatis serovar L2.

SEQ ID NO: 146 is the determined amino acid sequence for the Cap 1 CT529 ORF peptide #140-147 of C. trachomatis serovar L2.

SEQ ID NO: 147 is the determined amino acid sequence for the Cap 1 CT529 ORF peptide #138-146 of C. trachomatis serovar L2.

SEQ ID NO: 148 is the determined amino acid sequence for the Cap 1 CT529 ORF peptide #138-145 of C. trachomatis serovar L2.

SEQ ID NO: 149 is the determined amino acid sequence for the Cap 1 CT529 ORF peptide #F140->I of C. trachomatis serovar L2.

SEQ ID NO: 150 is the determined amino acid sequence for the Cap 1 CT529 ORF peptide ##S139>Ga of C. trachomatis serovar L2.

SEQ ID NO: 151 is the determined amino acid sequence for the Cap 1 CT529 ORF peptide ##S139>Gb of C. trachomatis serovar L2.

SEQ ID NO: 152 is the determined amino acid sequence for the peptide #2 C7.8-6 of the 216aa ORF of C. trachomatis serovar L2.

SEQ ID NO: 153 is the determined amino acid sequence for the peptide #2 C7.8-7 of the 216aa ORF of C. trachomatis serovar L2.

SEQ ID NO: 154 is the determined amino acid sequence for the peptide #2 C7.8-8 of the 216aa ORF of C. trachomatis serovar L2.

SEQ ID NO: 155 is the determined amino acid sequence for the peptide #2 C7.8-9 of the 216aa ORF of C. trachomatis serovar L2.

SEQ ID NO: 156 is the determined amino acid sequence for the peptide #2 C7.8-10 of the 216aa ORF of C. trachomatis serovar L2.

SEQ ID NO: 157 is the determined amino acid sequence for the 53 amino acid residue peptide of the 216aa ORF within clone 2C7.8 of C. trachomatis serovar L2.

SEQ ID NO: 158 is the determined amino acid sequence for the 52 amino acid residue peptide of the CT529 ORF within clone 2C7.8 of C. trachomatis serovar L2.

SEQ ID NO: 159 is the determined DNA sequence for the 5' (forward) primer for cloning full-length CT529 serovar L2.

SEQ ID NO: 160 is the determined DNA sequence for the 5' (reverse) primer for cloning full-length CT529 serovar L2.

SEQ ID NO: 161 is the determined DNA sequence for the 5' (forward) primer for cloning full-length CT529 for serovars other than L2 and MOPN.

SEQ ID NO: 162 is the determined DNA sequence for the 5' (reverse) primer for cloning full-length CT529 serovars other than L2 and MOPN.

SEQ ID NO: 163 is the determined DNA sequence for the 5' (forward) primer for cloning full-length CT529 serovar MOPN.

SEQ ID NO: 164 is the determined DNA sequence for the 5' (reverse) primer for cloning full-length CT529 serovar MOPN.

SEQ ID NO: 165 is the determined DNA sequence for the 5' (forward) primer for pBIB-KS.

SEQ ID NO: 166 is the determined DNA sequence for the 5' (reverse) primer for pBIB-KS.

SEQ ID NO: 167 is the determined amino acid sequence for the 9-mer epitope peptide Cap1#139-147 from serovar L2.

SEQ ID NO: 168 is the determined amino acid sequence for the 9-mer epitope peptide Cap1#139-147 from serovar D.

SEQ ID NO: 169 is the determined full-length DNA sequence for the C. trachomatis pmpI (CT874) gene.

SEQ ID NO: 170 is the determined full-length DNA sequence for the C. trachomatis pmpG gene.

SEQ ID NO: 171 is the determined full-length DNA sequence for the C. trachomatis pmpE gene.

SEQ ID NO: 172 is the determined full-length DNA sequence for the C. trachomatis pmpD gene.

SEQ ID NO: 173 is the determined full-length DNA sequence for the C. trachomatis pmpC gene.

SEQ ID NO: 174 is the determined full-length DNA sequence for the C. trachomatis pmpB gene.

SEQ ID NO: 175 is the predicted full-length amino acid sequence for the C. trachomatis pmpI gene.

SEQ ID NO: 176 is the predicted full-length amino acid sequence for the C. trachomatis pmpG gene.

SEQ ID NO: 177 is the predicted full-length amino acid sequence for the C. trachomatis pmpE gene.

SEQ ID NO: 178 is the predicted full-length amino acid sequence for the C. trachomatis pmpD gene.

SEQ ID NO: 179 is the predicted full-length amino acid sequence for the C. trachomatis pmpC gene.

SEQ ID NO: 180 is the predicted full-length amino acid sequence for the C. trachomatis pmpB gene.

SEQ ID NO: 181 is the determined DNA sequence minus the signal sequence for the C. trachomatis pmpI gene.

SEQ ID NO: 182 is a subsequently determined full-length DNA sequence for the C. trachomatis pmpG gene.

SEQ ID NO: 183 is the determined DNA sequence minus the signal sequence for the C. trachomatis pmpE gene.

SEQ ID NO: 184 is a first determined DNA sequence representing the carboxy terminus for the *C. trachomatis* pmpD gene.

SEQ ID NO: 185 is a second determined DNA sequence representing the amino terminus minus the signal sequence for the *C. trachomatis* pmpD gene.

SEQ ID NO: 186 is a first determined DNA sequence representing the carboxy terminus for the *C. trachomatis* pmpC gene.

SEQ ID NO: 187 is a second determined DNA sequence representing the amino terminus minus the signal sequence for the *C. trachomatis* pmpC gene.

SEQ ID NO: 188 is the determined DNA sequence representing the *C. pneumoniae* serovar MOMPS pmp gene in a fusion molecule with Ra12.

SEQ ID NO: 189 is the predicted amino acid sequence minus the signal sequence for the *C. trachomatis* pmpI gene.

SEQ ID NO: 190 is subsequently predicted amino acid sequence for the *C. trachomatis* pmpG gene.

SEQ ID NO: 191 is the predicted amino acid sequence minus the signal sequence for the *C. trachomatis* pmpE gene.

SEQ ID NO: 192 is a first predicted amino acid sequence representing the carboxy terminus for the *C. trachomatis* pmpD gene.

SEQ ID NO: 193 is a second predicted amino acid sequence representing the Amino terminus minus the signal sequence for the *C. trachomatis* pmpD gene.

SEQ ID NO: 194 is a first predicted amino acid sequence representing the Carboxy terminus for the *C. trachomatis* pmpC gene.

SEQ ID NO: 195 is a second predicted amino acid sequence representing the Amino terminus for the *C. trachomatis* pmpC gene.

SEQ ID NO: 196 is the predicted amino acid sequence representing the *C. pneumoniae* serovar MOMPS pmp gene in a fusion molecule with Ra12.

SEQ ID NO: 197 is the determined DNA sequence for the 5' oligo primer for cloning the *C. trachomatis* pmpC gene in the SKB vaccine vector.

SEQ ID NO: 198 is the determined DNA sequence for the 3' oligo primer for cloning the *C. trachomatis* pmpC gene in the SKB vaccine vector.

SEQ ID NO: 199 is the determined DNA sequence for the insertion sequence for cloning the *C. trachomatis* pmpC gene in the SKB vaccine vector.

SEQ ID NO: 200 is the determined DNA sequence for the 5' oligo primer for cloning the *C. trachomatis* pmpD gene in the SKB vaccine vector.

SEQ ID NO: 201 is the determined DNA sequence for the 3' oligo primer for cloning the *C. trachomatis* pmpD gene in the SKB vaccine vector.

SEQ ID NO: 202 is the determined DNA sequence for the insertion sequence for cloning the *C. trachomatis* pmpD gene in the SKB vaccine vector.

SEQ ID NO: 203 is the determined DNA sequence for the 5' oligo primer for cloning the *C. trachomatis* pmpE gene in the SKB vaccine vector.

SEQ ID NO: 204 is the determined DNA sequence for the 3' oligo primer for cloning the *C. trachomatis* pmpE gene in the SKB vaccine vector.

SEQ ID NO: 205 is the determined DNA sequence for the 5' oligo primer for cloning the *C. trachomatis* pmpG gene in the SKB vaccine vector.

SEQ ID NO: 206 is the determined DNA sequence for the 3' oligo primer for cloning the *C. trachomatis* pmpG gene in the SKB vaccine vector.

SEQ ID NO: 207 is the determined DNA sequence for the 5' oligo primer for cloning the amino terminus portion of the *C. trachomatis* pmpC gene in the pET17b vector.

SEQ ID NO: 208 is the determined DNA sequence for the 3' oligo primer for cloning the amino terminus portion of the *C. trachomatis* pmpC gene in the pET17b vector.

SEQ ID NO: 209 is the determined DNA sequence for the 5' oligo primer for cloning the carboxy terminus portion of the *C. trachomatis* pmpC gene in the pET17b vector.

SEQ ID NO: 210 is the determined DNA sequence for the 3' oligo primer for cloning the carboxy terminus portion of the *C. trachomatis* pmpC gene in the pET17b vector.

SEQ ID NO: 211 is the determined DNA sequence for the 5' oligo primer for cloning the amino terminus portion of the *C. trachomatis* pmpD gene in the pET17b vector.

SEQ ID NO: 212 is the determined DNA sequence for the 3' oligo primer for cloning the amino terminus portion of the *C. trachomatis* pmpD gene in the pET17b vector.

SEQ ID NO: 213 is the determined DNA sequence for the 5' oligo primer for cloning the carboxy terminus portion of the *C. trachomatis* pmpD gene in the pET17b vector.

SEQ ID NO: 214 is the determined DNA sequence for the 3' oligo primer for cloning the carboxy terminus portion of the *C. trachomatis* pmpD gene in the pET17b vector.

SEQ ID NO: 215 is the determined DNA sequence for the 5' oligo primer for cloning the *C. trachomatis* pmpE gene in the pET17b vector.

SEQ ID NO: 216 is the determined DNA sequence for the 3' oligo primer for cloning the *C. trachomatis* pmpE gene in the pET17b vector.

SEQ ID NO: 217 is the determined DNA sequence for the insertion sequence for cloning the *C. trachomatis* pmpE gene in the pET17b vector.

SEQ ID NO: 218 is the amino acid sequence for the insertion sequence for cloning the *C. trachomatis* pmpE gene in the pET17b vector.

SEQ ID NO: 219 is the determined DNA sequence for the 5' oligo primer for cloning the *C. trachomatis* pmpG gene in the pET17b vector.

SEQ ID NO: 220 is the determined DNA sequence for the 3' oligo primer for cloning the *C. trachomatis* pmpG gene in the pET17b vector.

SEQ ID NO: 221 is the amino acid sequence for the insertion sequence for cloning the *C. trachomatis* pmpG gene in the pET17b vector.

SEQ ID NO: 222 is the determined DNA sequence for the 5' oligo primer for cloning the *C. trachomatis* pmpI gene in the pET17b vector.

SEQ ID NO: 223 is the determined DNA sequence for the 3' oligo primer for cloning the *C. trachomatis* pmpI gene in the pET17b vector.

SEQ ID NO: 224 is the determined amino acid sequence for the *C. pneumoniae* Swib peptide 1-20.

SEQ ID NO: 225 is the determined amino acid sequence for the *C. pneumoniae* Swib peptide 6-25.

SEQ ID NO: 226 is the determined amino acid sequence for the *C. pneumoniae* Swib peptide 12-31.

SEQ ID NO: 227 is the determined amino acid sequence for the *C. pneumoniae* Swib peptide 17-36.

SEQ ID NO: 228 is the determined amino acid sequence for the *C. pneumoniae* Swib peptide 22-41.

SEQ ID NO: 229 is the determined amino acid sequence for the *C. pneumoniae* Swib peptide 27-46.

SEQ ID NO: 230 is the determined amino acid sequence for the *C. pneumoniae* Swib peptide 42-61.

SEQ ID NO: 231 is the determined amino acid sequence for the *C. pneumoniae* Swib peptide 46-65.

SEQ ID NO: 232 is the determined amino acid sequence for the C. pneumoniae Swib peptide 51-70.

SEQ ID NO: 233 is the determined amino acid sequence for the C. pneumoniae Swib peptide 56-75.

SEQ ID NO: 234 is the determined amino acid sequence for the C. pneumoniae Swib peptide 61-80.

SEQ ID NO: 235 is the determined amino acid sequence for the C. pneumoniae Swib peptide 66-87.

SEQ ID NO: 236 is the determined amino acid sequence for the C. trachomatis OMCB peptide 103-122.

SEQ ID NO: 237 is the determined amino acid sequence for the C. trachomatis OMCB peptide 108-127.

SEQ ID NO: 238 is the determined amino acid sequence for the C. trachomatis OMCB peptide 113-132.

SEQ ID NO: 239 is the determined amino acid sequence for the C. trachomatis OMCB peptide 118-137.

SEQ ID NO: 240 is the determined amino acid sequence for the C. trachomatis OMCB peptide 123-143.

SEQ ID NO: 241 is the determined amino acid sequence for the C. trachomatis OMCB peptide 128-147.

SEQ ID NO: 242 is the determined amino acid sequence for the C. trachomatis OMCB peptide 133-152.

SEQ ID NO: 243 is the determined amino acid sequence for the C. trachomatis OMCB peptide 137-156.

SEQ ID NO: 244 is the determined amino acid sequence for the C. trachomatis OMCB peptide 142-161.

SEQ ID NO: 245 is the determined amino acid sequence for the C. trachomatis OMCB peptide 147-166.

SEQ ID NO: 246 is the determined amino acid sequence for the C. trachomatis OMCB peptide 152-171.

SEQ ID NO: 247 is the determined amino acid sequence for the C. trachomatis OMCB peptide 157-176.

SEQ ID NO: 248 is the determined amino acid sequence for the C. trachomatis OMCB peptide 162-181.

SEQ ID NO: 249 is the determined amino acid sequence for the C. trachomatis OMCB peptide 167-186.

SEQ ID NO: 250 is the determined amino acid sequence for the C. trachomatis OMCB peptide 171-190.

SEQ ID NO: 251 is the determined amino acid sequence for the C. trachomatis OMCB peptide 171-186.

SEQ ID NO: 252 is the determined amino acid sequence for the C. trachomatis OMCB peptide 175-186.

SEQ ID NO: 252 is the determined amino acid sequence for the C. trachomatis OMCB peptide 175-186.

SEQ ID NO: 253 is the determined amino acid sequence for the C. pneumoniae OMCB peptide 185-198.

SEQ ID NO: 254 is the determined amino acid sequence for the C. trachomatis TSA peptide 96-115.

SEQ ID NO: 255 is the determined amino acid sequence for the C. trachomatis TSA peptide 101-120.

SEQ ID NO: 256 is the determined amino acid sequence for the C. trachomatis TSA peptide 106-125.

SEQ ID NO: 257 is the determined amino acid sequence for the C. trachomatis TSA peptide 111-130.

SEQ ID NO: 258 is the determined amino acid sequence for the C. trachomatis TSA peptide 116-135.

SEQ ID NO: 259 is the determined amino acid sequence for the C. trachomatis TSA peptide 121-140.

SEQ ID NO: 260 is the determined amino acid sequence for the C. trachomatis TSA peptide 126-145.

SEQ ID NO: 261 is the determined amino acid sequence for the C. trachomatis TSA peptide 131-150.

SEQ ID NO: 262 is the determined amino acid sequence for the C. trachomatis TSA peptide 136-155.

SEQ ID NO: 263 is the determined full-length DNA sequence for the C. trachomatis CT529/Cap 1 gene serovar I.

SEQ ID NO: 264 is the predicted full-length amino sequence for the C. trachomatis CT529/Cap 1 gene serovar I.

SEQ ID NO: 265 is the determined full-length DNA sequence for the C. trachomatis CT529/Cap 1 gene serovar K.

SEQ ID NO: 266 is the predicted full-length amino sequence for the C. trachomatis CT529/Cap 1 gene serovar K.

SEQ ID NO: 267 is the determined DNA sequence for the C. trachomatis clone 17-G4-36 sharing homology to part of the ORF of DNA-directed RNA polymerase beta subunit-CT315 in serD.

SEQ ID NO: 268 is the determined DNA sequence for the partial sequence of the C. trachomatis CT016 gene in clone 2E10.

SEQ ID NO: 269 is the determined DNA sequence for the partial sequence of the C. trachomatis tRNA syntase gene in clone 2E10.

SEQ ID NO: 270 is the determined DNA sequence for the partial sequence for the C. trachomatis clpX gene in clone 2E10.

SEQ ID NO: 271 is a first determined DNA sequence for the C. trachomatis clone CtL2gam-30 representing the 5' end.

SEQ ID NO: 272 is a second determined DNA sequence for the C. trachomatis clone CtL2gam-30 representing the 3' end.

SEQ ID NO: 273 is the determined DNA sequence for the C. trachomatis clone CtL2gam-28.

SEQ ID NO: 274 is the determined DNA sequence for the C. trachomatis clone CtL2gam-27.

SEQ ID NO: 275 is the determined DNA sequence for the C. trachomatis clone CtL2gam-26.

SEQ ID NO: 276 is the determined DNA sequence for the C. trachomatis clone CtL2gam-24.

SEQ ID NO: 277 is the determined DNA sequence for the C. trachomatis clone CtL2gam-23.

SEQ ID NO: 278 is the determined DNA sequence for the C. trachomatis clone CtL2gam-21.

SEQ ID NO: 279 is the determined DNA sequence for the C. trachomatis clone CtL2gam-18.

SEQ ID NO: 280 is the determined DNA sequence for the C. trachomatis clone CtL2gam-17.

SEQ ID NO: 281 is a first determined DNA sequence for the C. trachomatis clone CtL2gam-15 representing the 5' end.

SEQ ID NO: 282 is a second determined DNA sequence for the C. trachomatis clone CtL2gam-15 representing the 3' end.

SEQ ID NO: 283 is the determined DNA sequence for the C. trachomatis clone CtL2gam-13.

SEQ ID NO: 284 is the determined DNA sequence for the C. trachomatis clone CtL2gam-10.

SEQ ID NO: 285 is the determined DNA sequence for the C. trachomatis clone CtL2gam-8.

SEQ ID NO: 286 is a first determined DNA sequence for the C. trachomatis clone CtL2gam-6 representing the 5' end.

SEQ ID NO: 287 is a second determined DNA sequence for the C. trachomatis clone CtL2gam-6 representing the 3' end.

SEQ ID NO: 288 is the determined DNA sequence for the C. trachomatis clone CtL2gam-5.

SEQ ID NO: 289 is the determined DNA sequence for the C. trachomatis clone CtL2gam-2.

SEQ ID NO: 290 is the determined DNA sequence for the C. trachomatis clone CtL2gam-1.

SEQ ID NO: 291 is the determined full-length DNA sequence for the C. pneumoniae homologue of the CT529 gene.

SEQ ID NO: 292 is the predicted full-length amino acid sequence for the *C. pneumoniae* homologue of the CT529 gene.

SEQ ID NO: 293 is the determined DNA sequence for the insertion sequence for cloning the *C. trachomatis* pmpG gene in the SKB vaccine vector.

SEQ ID NO: 294 is the amino acid sequence of an open reading frame of clone CT603.

SEQ ID NO: 295 is the amino acid sequence of a first open reading frame of clone CT875.

SEQ ID NO: 296 is the amino acid sequence of a second open reading frame of clone CT875.

SEQ ID NO: 297 is the amino acid sequence of a first open reading frame of clone CT858.

SEQ ID NO: 298 is the amino acid sequence of a second open reading frame of clone CT858.

SEQ ID NO: 299 is the amino acid sequence of an open reading frame of clone CT622.

SEQ ID NO: 300 is the amino acid sequence of an open reading frame of clone CT610.

SEQ ID NO: 301 is the amino acid sequence of an open reading frame of clone CT396.

SEQ ID NO: 302 is the amino acid sequence of an open reading frame of clone CT318.

SEQ ID NO: 304 is the amino acid sequence for *C. trachomatis*, serovar L2 rCt529c1-125 having a modified N-terminal sequence (6-His tag).

SEQ ID NO: 305 is the amino acid sequence for *C. trachomatis*, serovar L2 rCt529c1-125.

SEQ ID NO: 306 is the sense primer used in the synthesis of the PmpA(N-term) fusion protein.

SEQ ID NO: 307 is the antisense primer used in the synthesis of the PmpA(N-term) fusion protein.

SEQ ID NO: 308 is the DNA sequence encoding the PmpA (N-term) fusion protein.

SEQ ID NO: 309 is the amino acid sequence of the PmpA (N-term) fusion protein.

SEQ ID NO: 310 is the sense primer used in the synthesis of the PmpA(C-term) fusion protein.

SEQ ID NO: 311 is the antisense primer used in the synthesis of the PmpA(C-term) fusion protein.

SEQ ID NO: 312 is the DNA sequence encoding the PmpA (C-term) fusion protein.

SEQ ID NO: 313 is the amino acid sequence of the PmpA (C-term) fusion protein.

SEQ ID NO: 314 is the sense primer used in the synthesis of the PmpF(N-term) fusion protein.

SEQ ID NO: 315 is the antisense primer used in the synthesis of the PmpF(N-term) fusion protein.

SEQ ID NO: 316 is the DNA sequence encoding the PmpF (N-term) fusion protein.

SEQ ID NO: 317 is the amino acid sequence of the PmpF (N-term) fusion protein.

SEQ ID NO: 318 is the sense primer used in the synthesis of the PmpF(C-term) fusion protein.

SEQ ID NO: 319 is the antisense primer used in the synthesis of the PmpF(C-term) fusion protein.

SEQ ID NO: 320 is the DNA sequence encoding the PmpF (C-term) fusion protein.

SEQ ID NO: 321 is the amino acid sequence of the PmpF (C-term) fusion protein.

SEQ ID NO: 322 is the sense primer used in the synthesis of the PmpH (CT412) (N-term) fusion protein.

SEQ ID NO: 323 is the antisense primer used in the synthesis of the PmpH(N-term) fusion protein.

SEQ ID NO: 324 is the DNA sequence encoding the PmpH (N-term) fusion protein.

SEQ ID NO: 325 is the amino acid sequence of the PmpH (N-term) fusion protein.

SEQ ID NO: 326 is the sense primer used in the synthesis of the PmpH(C-term) fusion protein.

SEQ ID NO: 327 is the antisense primer used in the synthesis of the PmpH(C-term) fusion protein.

SEQ ID NO: 328 is the DNA sequence encoding the PmpH (C-term) fusion protein.

SEQ ID NO: 329 is the amino acid sequence of the PmpH (C-term) fusion protein.

SEQ ID NO: 330 is the sense primer used in the synthesis of the PmpB(1) fusion protein.

SEQ ID NO: 331 is the antisense primer used in the synthesis of the PmpB(1) fusion protein.

SEQ ID NO: 332 is the DNA sequence encoding the PmpB (1) fusion protein.

SEQ ID NO: 333 is the amino acid sequence of the PmpB (1) fusion protein.

SEQ ID NO: 334 is the sense primer used in the synthesis of the PmpB(2) fusion protein.

SEQ ID NO: 335 is the antisense primer used in the synthesis of the PmpB(2) fusion protein.

SEQ ID NO: 336 is the DNA sequence encoding the PmpB (2) fusion protein.

SEQ ID NO: 337 is the amino acid sequence of the PmpB (2) fusion protein.

SEQ ID NO: 338 is the sense primer used in the synthesis of the PmpB(3) fusion protein.

SEQ ID NO: 339 is the antisense primer used in the synthesis of the PmpB(3) fusion protein.

SEQ ID NO: 340 is the DNA sequence encoding the PmpB (3) fusion protein.

SEQ ID NO: 341 is the amino acid sequence of the PmpB (3) fusion protein.

SEQ ID NO: 342 is the sense primer used in the synthesis of the PmpB(4) fusion protein.

SEQ ID NO: 343 is the antisense primer used in the synthesis of the PmpB(4) fusion protein.

SEQ ID NO: 344 is the DNA sequence encoding the PmpB (4) fusion protein.

SEQ ID NO: 345 is the amino acid sequence of the PmpB (4) fusion protein.

SEQ ID NO: 346 is the sense primer used in the synthesis of the PmpC(1) fusion protein.

SEQ ID NO: 347 is the antisense primer used in the synthesis of the PmpC(1) fusion protein.

SEQ ID NO: 348 is the DNA sequence encoding the PmpC (1) fusion protein.

SEQ ID NO: 349 is the amino acid sequence of the PmpC (1) fusion protein.

SEQ ID NO: 350 is the sense primer used in the synthesis of the PmpC(2) fusion protein.

SEQ ID NO: 351 is the antisense primer used in the synthesis of the PmpC(2) fusion protein.

SEQ ID NO: 352 is the DNA sequence encoding the PmpC (2) fusion protein.

SEQ ID NO: 353 is the amino acid sequence of the PmpC (2) fusion protein.

SEQ ID NO: 354 is the sense primer used in the synthesis of the PmpC(3) fusion protein.

SEQ ID NO: 355 is the antisense primer used in the synthesis of the PmpC(3) fusion protein.

SEQ ID NO: 356 is the DNA sequence encoding the PmpC (3) fusion protein.

SEQ ID NO: 357 is the amino acid sequence of the PmpC (3) fusion protein.

SEQ ID NO: 358 is the DNA sequence of the oppA1 protein, devoid of the first trans-membrane domain.

SEQ ID NO: 359 is the full length DNA sequence of CT139.

SEQ ID NO: 360 is the full length DNA sequence of ORF-3.

SEQ ID NO: 361 is the full length DNA sequence of CT611.

SEQ ID NO: 362 is the amino acid sequence of oppA1 starting from amino acid 22.

SEQ ID NO: 363 is the amino acid sequence of CT139.

SEQ ID NO: 364 is the amino acid sequence of ORF-3.

SEQ ID NO: 365 is the amino acid sequence of CT611.

SEQ ID NO: 366 sets forth the DNA sequence for the *Chlamydia pneumoniae* homologue, CPn0275, of the *Chlamydia trachomatis* gene CT190.

SEQ ID NO: 367 sets forth the DNA sequence for the *Chlamydia pneumoniae* homologue, CPn0407, of the *Chlamydia trachomatis* gene CT103.

SEQ ID NO: 368 sets forth the DNA sequence for the *Chlamydia pneumoniae* homologue, CPn0720, of the *Chlamydia trachomatis* gene CT659.

SEQ ID NO: 369 sets forth the DNA sequence for the *Chlamydia pneumoniae* homologue, CPn0716, of the *Chlamydia trachomatis* gene CT660.

SEQ ID NO: 370 sets forth the DNA sequence for the *Chlamydia pneumoniae* homologue, CPn0519, of the *Chlamydia trachomatis* gene CT430.

SEQ ID NO: 371 sets forth the DNA sequence for the *Chlamydia pneumoniae* homologue, CPn0520, of the *Chlamydia trachomatis* gene CT431.

SEQ ID NO: 372 sets forth the DNA sequence for the *Chlamydia pneumoniae* homologue, CPn0078, of the *Chlamydia trachomatis* gene CT318.

SEQ ID NO: 373 sets forth the DNA sequence for the *Chlamydia pneumoniae* homologue, CPn0628, of the *Chlamydia trachomatis* gene CT509.

SEQ ID NO: 374 sets forth the DNA sequence for the *Chlamydia pneumoniae* homologue, CPn0540, of the *Chlamydia trachomatis* gene CT414.

SEQ ID NO: 375 sets forth the DNA sequence for the *Chlamydia pneumoniae* homologue, pmp20, of the *Chlamydia trachomatis* gene CT413.

SEQ ID NO: 376 sets forth the DNA sequence for the *Chlamydia pneumoniae* homologue, CPn0081, of the *Chlamydia trachomatis* gene CT315.

SEQ ID NO: 377 sets forth the DNA sequence for the *Chlamydia pneumoniae* homologue, CPn0761, of the *Chlamydia trachomatis* gene CT610.

SEQ ID NO: 378 sets forth the DNA sequence for the *Chlamydia pneumoniae* homologue, CPn0557, of the *Chlamydia trachomatis* gene CT443.

SEQ ID NO: 379 sets forth the DNA sequence for the *Chlamydia pneumoniae* homologue, CPn0833, of the *Chlamydia trachomatis* gene CT557.

SEQ ID NO: 380 sets forth the DNA sequence for the *Chlamydia pneumoniae* homologue, CPn0134, of the *Chlamydia trachomatis* gene CT604.

SEQ ID NO: 381 sets forth the DNA sequence for the *Chlamydia pneumoniae* homologue, CPn0388, of the *Chlamydia trachomatis* gene CT042.

SEQ ID NO: 382 sets forth the DNA sequence for the *Chlamydia pneumoniae* homologue, CPn1028, of the *Chlamydia trachomatis* gene CT376.

SEQ ID NO: 383 sets forth the DNA sequence for the *Chlamydia pneumoniae* homologue, CPn0875, of the *Chlamydia trachomatis* gene CT734.

SEQ ID NO: 384 sets forth the DNA sequence for the *Chlamydia pneumoniae* homologue, CPn0908, of the *Chlamydia trachomatis* gene CT764.

SEQ ID NO: 385 sets forth the DNA sequence for the *Chlamydia pneumoniae* homologue, CPn0728, of the *Chlamydia trachomatis* gene CT622.

SEQ ID NO: 386 sets forth the amino acid sequence for the *Chlamydia pneumoniae* homologue, CPn0275, of the *Chlamydia trachomatis* gene CT190.

SEQ ID NO: 387 sets forth the amino acid sequence for the *Chlamydia pneumoniae* homologue, CPn0407, of the *Chlamydia trachomatis* gene CT103.

SEQ ID NO: 388 sets forth the amino acid sequence for the *Chlamydia pneumoniae* homologue, CPn0720, of the *Chlamydia trachomatis* gene CT659.

SEQ ID NO: 389 sets forth the amino acid sequence for the *Chlamydia pneumoniae* homologue, CPn0716, of the *Chlamydia trachomatis* gene CT660.

SEQ ID NO: 390 sets forth the amino acid sequence for the *Chlamydia pneumoniae* homologue, CPn0519, of the *Chlamydia trachomatis* gene CT430.

SEQ ID NO: 391 sets forth the amino acid sequence for the *Chlamydia pneumoniae* homologue, CPn0520, of the *Chlamydia trachomatis* gene CT431.

SEQ ID NO: 392 sets forth the amino acid sequence for the *Chlamydia pneumoniae* homologue, CPn0078, of the *Chlamydia trachomatis* gene CT318.

SEQ ID NO: 393 sets forth the amino acid sequence for the *Chlamydia pneumoniae* homologue, CPn0628, of the *Chlamydia trachomatis* gene CT509.

SEQ ID NO: 394 sets forth the amino acid sequence for the *Chlamydia pneumoniae* homologue, CPn0540, of the *Chlamydia trachomatis* gene CT414.

SEQ ID NO: 395 sets forth the amino acid sequence for the *Chlamydia pneumoniae* homologue, pmp20, of the *Chlamydia trachomatis* gene CT413.

SEQ ID NO: 396 sets forth the amino acid sequence for the *Chlamydia pneumoniae* homologue, CPn0081, of the *Chlamydia trachomatis* gene CT315.

SEQ ID NO: 397 sets forth the amino acid sequence for the *Chlamydia pneumoniae* homologue, CPn0761, of the *Chlamydia trachomatis* gene CT610.

SEQ ID NO: 398 sets forth the amino acid sequence for the *Chlamydia pneumoniae* homologue, CPn0557, of the *Chlamydia trachomatis* gene CT443.

SEQ ID NO: 399 sets forth the amino acid sequence for the *Chlamydia pneumoniae* homologue, CPn0833, of the *Chlamydia trachomatis* gene CT557.

SEQ ID NO: 400 sets forth the amino acid sequence for the *Chlamydia pneumoniae* homologue, CPn0134, of the *Chlamydia trachomatis* gene CT604.

SEQ ID NO: 401 sets forth the amino acid sequence for the *Chlamydia pneumoniae* homologue, CPn0388, of the *Chlamydia trachomatis* gene CT042.

SEQ ID NO: 402 sets forth the amino acid sequence for the *Chlamydia pneumoniae* homologue, CPn1028, of the *Chlamydia trachomatis* gene CT376.

SEQ ID NO: 403 sets forth the amino acid sequence for the *Chlamydia pneumoniae* homologue, CPn0875, of the *Chlamydia trachomatis* gene CT734.

SEQ ID NO: 404 sets forth the amino acid sequence for the *Chlamydia pneumoniae* homologue, CPn0908, of the *Chlamydia trachomatis* gene CT764.

SEQ ID NO: 405 sets forth the amino acid sequence for the *Chlamydia pneumoniae* homologue, CPn0728, of the *Chlamydia trachomatis* gene CT622.

SEQ ID NO: 406 sets forth the full-length serovar D DNA sequence of the *Chlamydia trachomatis* gene CT287.

SEQ ID NO: 407 sets forth the full-length serovar D DNA sequence of the *Chlamydia trachomatis* gene CT858.

SEQ ID NO: 408 sets forth the full-length serovar D DNA sequence of the *Chlamydia trachomatis* gene CT764.

SEQ ID NO: 409 sets forth the full-length serovar D DNA sequence of the *Chlamydia trachomatis* gene CT734.

SEQ ID NO: 410 sets forth the full-length serovar D DNA sequence of the *Chlamydia trachomatis* gene CT660.

SEQ ID NO: 411 sets forth the full-length serovar D DNA sequence of the *Chlamydia trachomatis* gene CT659.

SEQ ID NO: 412 sets forth the full-length serovar D DNA sequence of the *Chlamydia trachomatis* gene CT622.

SEQ ID NO: 413 sets forth the full-length serovar D DNA sequence of the *Chlamydia trachomatis* gene CT610.

SEQ ID NO: 414 sets forth the full-length serovar D DNA sequence of the *Chlamydia trachomatis* gene CT604.

SEQ ID NO: 415 sets forth the full-length serovar D DNA sequence of the *Chlamydia trachomatis* gene CT557.

SEQ ID NO: 416 sets forth the full-length serovar D DNA sequence of the *Chlamydia trachomatis* gene CT509.

SEQ ID NO: 417 sets forth the full-length serovar D DNA sequence of the *Chlamydia trachomatis* gene CT443.

SEQ ID NO: 418 sets forth the full-length serovar D DNA sequence of the *Chlamydia trachomatis* gene CT431.

SEQ ID NO: 419 sets forth the full-length serovar D DNA sequence of the *Chlamydia trachomatis* gene CT430.

SEQ ID NO: 420 sets forth the full-length serovar D DNA sequence of the *Chlamydia trachomatis* gene CT414.

SEQ ID NO: 421 sets forth the full-length serovar D DNA sequence of the *Chlamydia trachomatis* gene CT413.

SEQ ID NO: 422 sets forth the full-length serovar D DNA sequence of the *Chlamydia trachomatis* gene CT396.

SEQ ID NO: 423 sets forth the full-length serovar D DNA sequence of the *Chlamydia trachomatis* gene CT376.

SEQ ID NO: 424 sets forth the full-length serovar D DNA sequence of the *Chlamydia trachomatis* gene CT318.

SEQ ID NO: 425 sets forth the full-length serovar D DNA sequence of the *Chlamydia trachomatis* gene CT315.

SEQ ID NO: 426 sets forth the full-length serovar D DNA sequence of the *Chlamydia trachomatis* gene CT104.

SEQ ID NO: 427 sets forth the full-length serovar D DNA sequence of the *Chlamydia trachomatis* gene CT103.

SEQ ID NO: 428 sets forth the full-length serovar D DNA sequence of the *Chlamydia trachomatis* gene CT102.

SEQ ID NO: 429 sets forth the full-length serovar D DNA sequence of the *Chlamydia trachomatis* gene CT098.

SEQ ID NO: 430 sets forth the full-length serovar D DNA sequence of the *Chlamydia trachomatis* gene CT042.

SEQ ID NO: 431 sets forth the full-length serovar D amino acid sequence of the *Chlamydia trachomatis* gene CT858.

SEQ ID NO: 432 sets forth the full-length serovar D amino acid sequence of the *Chlamydia trachomatis* gene CT764.

SEQ ID NO: 433 sets forth the full-length serovar D amino acid sequence of the *Chlamydia trachomatis* gene CT734.

SEQ ID NO: 434 sets forth the full-length serovar D amino acid sequence of the *Chlamydia trachomatis* gene CT660.

SEQ ID NO: 435 sets forth the full-length serovar D amino acid sequence of the *Chlamydia trachomatis* gene CT659.

SEQ ID NO: 436 sets forth the full-length serovar D amino acid sequence of the *Chlamydia trachomatis* gene CT622.

SEQ ID NO: 437 sets forth the full-length serovar D amino acid sequence of the *Chlamydia trachomatis* gene CT610.

SEQ ID NO: 438 sets forth the full-length serovar D amino acid sequence of the *Chlamydia trachomatis* gene CT604.

SEQ ID NO: 439 sets forth the full-length serovar D amino acid sequence of the *Chlamydia trachomatis* gene CT557.

SEQ ID NO: 440 sets forth the full-length serovar D amino acid sequence of the *Chlamydia trachomatis* gene CT509.

SEQ ID NO: 441 sets forth the full-length serovar D amino acid sequence of the *Chlamydia trachomatis* gene CT443.

SEQ ID NO: 442 sets forth the full-length serovar D amino acid sequence of the *Chlamydia trachomatis* gene CT431.

SEQ ID NO: 443 sets forth the full-length serovar D amino acid sequence of the *Chlamydia trachomatis* gene CT430.

SEQ ID NO: 444 sets forth the full-length serovar D amino acid sequence of the *Chlamydia trachomatis* gene CT414.

SEQ ID NO: 445 sets forth the full-length serovar D amino acid sequence of the *Chlamydia trachomatis* gene CT413.

SEQ ID NO: 446 sets forth the full-length serovar D amino acid sequence of the *Chlamydia trachomatis* gene CT396.

SEQ ID NO: 447 sets forth the full length serovar D amino acid sequence of the *Chlamydia trachomatis* gene CT376.

SEQ ID NO: 448 sets forth the full length serovar D amino acid sequence of the *Chlamydia trachomatis* gene CT318.

SEQ ID NO: 449 sets forth the full length serovar D amino acid sequence of the *Chlamydia trachomatis* gene CT315.

SEQ ID NO: 450 sets forth the full length serovar D amino acid sequence of the *Chlamydia trachomatis* gene CT104.

SEQ ID NO: 451 sets forth the full length serovar D amino acid sequence of the *Chlamydia trachomatis* gene CT103.

SEQ ID NO: 452 sets forth the full length serovar D amino acid sequence of the *Chlamydia trachomatis* gene CT102.

SEQ ID NO: 453 sets forth the full length serovar D amino acid sequence of the *Chlamydia trachomatis* gene CT098.

SEQ ID NO: 454 sets forth the full length serovar D amino acid sequence of the *Chlamydia trachomatis* gene CT042.

SEQ ID NO: 455 corresponds to the DNA sequence of CPn0894, which is the CP homologue of CT751 (amn), which was identified in clones CTL2-1, and CTL2-5.

SEQ ID NO: 456 corresponds to the DNA sequence of CPn0074, which is the CP homologue of CT322 (tuf), which was identified in clone CTL2-2.

SEQ ID NO: 457 corresponds to the DNA sequence of CPn0122, which is the CP homologue of CT032 (metG), which was identified in clones CTL2gam2, CTL2-3(5') and CTL2-4.

SEQ ID NO: 458 corresponds to the DNA sequence of CPn0121, which is the CP homologue of CT031, which was identified in clone CTL2-3(5')(3').

SEQ ID NO: 459 corresponds to the DNA sequence of CPn0120, which is the CP homologue of CT030 (gmK), which was identified in clones CTL2-3(3') and CTL2-21.

SEQ ID NO: 460 corresponds to the DNA sequence of CPn0359, which is the CP homologue of CT064 (lepA), which was identified in clone CTL2gam5.

SEQ ID NO: 461 corresponds to the DNA sequence of CPn0414, which is the CP homologue of CT265 (accA), which was identified in clone CTL2-6.

SEQ ID NO: 462 corresponds to the DNA sequence of CPn0413, which is the CP homologue of CT264 (msbA), which was identified in clone CTL2-6.

SEQ ID NO: 463 corresponds to the DNA sequence of CPn0394, which is the CP homologue of CT256 which was identified in clones CTL2gam6(5') and CTL2-11(5').

SEQ ID NO: 464 corresponds to the DNA sequence of CPn0395, which is the CP homologue of CT257 which was identified in clones CTL2gam6(5') and CTL2-11(5').

SEQ ID NO: 465 corresponds to the DNA sequence of CPn0487, which is the CP homologue of CT384 which was identified in clones CTL2gam6(3') and CTL2-11(3').

SEQ ID NO: 466 corresponds to the DNA sequence of CPn0592, which is the CP homologue of CT473, which was identified in clone CTL2-8b.

SEQ ID NO: 467 corresponds to the DNA sequence of CPn0593, which is the CP homologue of CT474, which was identified in clone CTL2-8b.

SEQ ID NO: 468 corresponds to the DNA sequence of CPn0197, which is the CP homologue of CT139 (oppA1), which was identified in clone CTL2-8b.

SEQ ID NO: 469 corresponds to the DNA sequence of CPn0363, which is the CP homologue of CT060 (flhA), which was identified in clone CTL2-8b.

SEQ ID NO: 470 corresponds to the DNA sequence of CPn0301, which is the CP homologue of CT242, which was identified in clone CTL2gam8.

SEQ ID NO: 471 corresponds to the DNA sequence of CPn0302, which is the CP homologue of CT243 (lpxD), which was identified in clone CTL2gam8.

SEQ ID NO: 472 corresponds to the DNA sequence of CPn0324, which is the CP homologue of CT089 (lcrE), which was identified in clones CTL2-9, CTL2gam1, CTL2gam17 and CTL2-19(5').

SEQ ID NO: 473 corresponds to the DNA sequence of CPn0761, which is the CP homologue of CT610, which was identified in clone CTL2-10(5')(3').

SEQ ID NO: 474 corresponds to the DNA sequence of CPn0760, which is the CP homologue of CT611, which was identified in clone CTL2-10(5').

SEQ ID NO: 475 corresponds to the DNA sequence of CPn0329, which is the CP homologue of CT154, which was identified in clones CTL2gam10 and CTL2gam21.

SEQ ID NO: 476 corresponds to the DNA sequence of CPn0990, which is the CP homologue of CT833 (infC), which was identified in clone CTL2-12.

SEQ ID NO: 477 corresponds to the DNA sequence of CPn0984, which is the CP homologue of CT827 (nrdA), which was identified in clones CTL2-16(3') and CTL2gam15 (3').

SEQ ID NO: 478 corresponds to the DNA sequence of CPn0985 which is the CP homologue of CT828 (nrdB) which was identified in clones CTL2-16(3') CTL2gam15(3').

SEQ ID NO: 479 corresponds to the DNA sequence of CPn0349, which is the CP homologue of CT067 (ytgA), which was identified in clone CTL2gam18.

SEQ ID NO: 480 corresponds to the DNA sequence of CPn0325, which is the CP homologue of CT088 (sycE), which was identified in clone CTL2-19(5').

SEQ ID NO: 481 corresponds to the DNA sequence of CPn0326, which is the CP homologue of CT087 (malQ), which was identified in clone CTL2-19(5').

SEQ ID NO: 482 corresponds to the DNA sequence of CPn0793, which is the CP homologue of CT588 (rbsu), which was identified in clone CTL2gam23.

SEQ ID NO: 483 corresponds to the DNA sequence of CPn0199, which is the CP homologue of CT199 (oppB1), which was identified in clone CTL2gam24.

SEQ ID NO: 484 corresponds to the DNA sequence of CPn0666, which is the CP homologue of CT545 (dnaE), which was identified in clone CTL2-24.

SEQ ID NO: 485 corresponds to the DNA sequence of CPn0065, which is the CP homologue of CT288, which was identified in clone CTL2gam27.

SEQ ID NO: 486 corresponds to the DNA sequence of CPn0444, which is the CP homologue of CT413 (pmpB), which was identified in clone CTL2gam30(5')(3').

SEQ ID NO: 487 corresponds to the DNA sequence of CPn-ORF5, which is the CP homologue of CT-ORF3, which was identified in clones CTL2gam15(5'), CTL2-16(5'), CTL2-18(5'), and CTL2-23.

SEQ ID NO: 488 corresponds to the DNA sequence of CPn-ORF6, which is the CP homologue of CT-ORF4, which was identified in clone CTL2-18(3').

SEQ ID NO: 489 corresponds to the DNA sequence of CP-ORF7, which is the CP homologue of CT-ORF5, which was identified in clone CTL2-18(3').

SEQ ID NO: 490 corresponds to the amino acid sequence of CPn0894, which is the CP homologue of CT751 (amn), which was identified in clones CTL2-1 and CTL2-5.

SEQ ID NO: 491 corresponds to the amino acid sequence of CPn0074, which is the CP homologue of CT332 (tuf), which was identified in clone CTL2-2.

SEQ ID NO: 492 corresponds to the amino acid sequence of CPn0122, which is the CP homologue of CT032 (metG), which was identified in clones CTL2gam2, CTL2-3(5') and CTL2-4.

SEQ ID NO: 493 corresponds to the amino acid sequence of CPn0121, which is the CP homologue of CT031, which was identified in clone CTL2-3(5')(3').

SEQ ID NO: 494 corresponds to the amino acid sequence of CPn0120 which is the CP homologue of CT030 (gmK) which was identified in clones CTL2-3 (3') and CTL2-21.

SEQ ID NO: 495 corresponds to the amino acid sequence of CPn0359, which is the CP homologue of CT064 (lepA), which was identified in clone CTL2gam5.

SEQ ID NO: 496 corresponds to the amino acid sequence of CPn0414, which is the CP homologue of CT265 (accA), which was identified in clone CTL2-6.

SEQ ID NO: 497 corresponds to the amino acid sequence of CPn0413, which is the CP homologue of CT264 (msbA), which was identified in clone CTL2-6.

SEQ ID NO: 498 corresponds to the amino acid sequence of CPn0394, which is the CP homologue of CT256, which was identified in clones CTL2gam6(5') and CTL2-11(5').

SEQ ID NO: 499 corresponds to the amino acid sequence of CPn0395, which is the CP homologue of CT257, which was identified in clones CTL2gam6(5') and CTL2-11(5').

SEQ ID NO: 500 corresponds to the amino acid sequence of CPn0487, which is the CP homologue of CT384, which was identified in clones CTL2gam6(3') and CTL2-11(3').

SEQ ID NO: 501 corresponds to the amino acid sequence of CPn0592, which is the CP homologue of CT473, which was identified in clone CTL2-8b.

SEQ ID NO: 502 corresponds to the amino acid sequence of CPn0593, which is the CP homologue of CT474, which was identified in clone CTL2-8b.

SEQ ID NO: 503 corresponds to the amino acid sequence of CPn0197, which is the CP homologue of CT139 (oppA1), which was identified in clone CTL2-8b.

SEQ ID NO: 504 corresponds to the amino acid sequence of CPn0363, which is the CP homologue of CT060 (flhA), which was identified in clone CTL2-8b.

SEQ ID NO: 505 corresponds to the amino acid sequence of CPn0301, which is the CP homologue of CT242, which was identified in clone CTL2gam8.

SEQ ID NO: 506 corresponds to the amino acid sequence of CPn0302, which is the CP homologue of CT243 (lpxD), which was identified in clone CTL2gam8.

SEQ ID NO: 507 corresponds to the amino acid sequence of CPn0324, which is the CP homologue of CT089 (lcrE), which was identified in clones CTL2-9, CTL2gam1, CTL2gam17 and CTL2-19(5').

SEQ ID NO: 508 corresponds to the amino acid sequence of CPn0761, which is the CP homologue of CT610, which was identified in clone CTL2-10(5')(3').

SEQ ID NO: 509 corresponds to the amino acid sequence of CPn0760, which is the CP homologue of CT611, which was identified in clone CTL2-10(5').

SEQ ID NO: 510 corresponds to the amino acid sequence of CPn0329, which is the CP homologue of CT154, which was identified in clones CTL2gam10 and CTL2gam21.

SEQ ID NO: 511 corresponds to the amino acid sequence of CPn0990, which is the CP homologue of CT833 (infC), which was identified in clone CTL2-12.

SEQ ID NO: 512 corresponds to the amino acid sequence of CPn-ORF5, which is the CP homologue of CT ORF3, which was identified in clones CTL2gam15(5'), CTL2-16 (5'), CTL2-18(5'), and CTL2-23.

SEQ ID NO: 513 corresponds to the amino acid sequence of CPn0984, which is the CP homologue of CT827 (nrdA) which was identified in clones CTL2-16(3') and CTL2gam15 (3').

SEQ ID NO: 514 corresponds to the amino acid sequence of CPn0985, which is the CP homologue of CT828 (nrdB) which was identified in clones CTL2-16(3') CTL2gam15(3').

SEQ ID NO: 515 corresponds to the amino acid sequence of CPn0349, which is the CP homologue of CT067 (ytgA), which was identified in clone CTL2gam18.

SEQ ID NO: 516 corresponds to the DNA sequence of CPn-ORF6, which is the CP homologue of CT-ORF4, which was identified in clone CTL2-18(3').

SEQ ID NO: 517 corresponds to the DNA sequence of CP-ORF7, which is the CP homologue of CT-ORF5, which was identified in clone CTL2-18(3').

SEQ ID NO: 518 corresponds to the amino acid sequence of CPn0326, which is the CP homologue of CT087 (malQ), which was identified in clone CTL2-19(5').

SEQ ID NO: 519 corresponds to the amino acid sequence of CPn0325, which is the CP homologue of CT088 (sycE), which was identified in clone CTL2-19(5').

SEQ ID NO: 520 corresponds to the amino acid sequence of CPn0793, which is the CP homologue of CT588 (rbsu), which was identified in clone CTL2gam23.

SEQ ID NO: 521 corresponds to the amino acid sequence of CPn0199, which is the CP homologue of CT199 (oppB1), which was identified in clone CTL2gam24.

SEQ ID NO: 522 corresponds to the amino acid sequence of CPn0666, which is the CP homologue of CT545 (dnaE), which was identified in clone CTL2-24.

SEQ ID NO: 523 corresponds to the DNA sequence of CPn0065, which is the CP homologue of CT288, which was identified in clone CTL2gam27.

SEQ ID NO: 524 corresponds to the DNA sequence of CPn0444, which is the CP homologue of CT413 (pmpB), which was identified in clone CTL2gam30(5')(3').

SEQ ID NO: 525 sets forth the full-length *C. trachomatis* serovar D DNA sequence homologous to the *C. trachomatis* LGV II sequence for CT751 (amn) identified from the clones CTL2-1 and CTL2-5.

SEQ ID NO: 526 sets forth the full-length *C. trachomatis* serovar D DNA sequence homologous to the *C. trachomatis* LGV II sequence for CT322 (tuff) identified from the clone CTL2-2.

SEQ ID NO: 527 sets forth the full-length *C. trachomatis* serovar D DNA sequence homologous to the *C. trachomatis* LGV II sequence for CT032 (metG) identified from the clones CTL2gam2, CTL2-3(5') and CTL2-4.

SEQ ID NO: 528 sets forth the full-length *C. trachomatis* serovar D DNA sequence homologous to the *C. trachomatis* LGV II sequence for CT031 identified from the clone CTL2-3(5')(3').

SEQ ID NO: 529 sets forth the full-length *C. trachomatis* serovar D DNA sequence homologous to the *C. trachomatis* LGV II sequence for CT030 (gmK) identified from the clones CTL2-3(3') and CTL2-21.

SEQ ID NO: 530 sets forth the full-length *C. trachomatis* serovar D DNA sequence homologous to the *C. trachomatis* LGV II sequence for CT064 (lepA) identified from the clone CTL2gam5.

SEQ ID NO: 531 sets forth the full-length *C. trachomatis* serovar D DNA sequence homologous to the *C. trachomatis* LGV II sequence for CT265 (accA) identified from the clone CTL2-6.

SEQ ID NO: 532 sets forth the full-length *C. trachomatis* serovar D DNA sequence homologous to the *C. trachomatis* LGV II sequence for CT624 (msbA) identified from the clones CTL2-6.

SEQ ID NO: 533 sets forth the full-length *C. trachomatis* serovar D DNA sequence homologous to the *C. trachomatis* LGV II sequence for CT256 identified from the clones CTL2gam6(5') and CTL2-11(5').

SEQ ID NO: 534 sets forth the full-length *C. trachomatis* serovar D DNA sequence homologous to the *C. trachomatis* LGV II sequence for CT257 identified from the clones CTL2gam6(5') and CTL2-11(5').

SEQ ID NO: 535 sets forth the full-length *C. trachomatis* serovar D DNA sequence homologous to the *C. trachomatis* LGV II sequence for CT384 identified from the clones CTL2gam6(3') and CTL2-11(3').

SEQ ID NO: 536 sets forth the full-length *C. trachomatis* serovar D DNA sequence homologous to the *C. trachomatis* LGV II sequence for CT473 identified from the clone CTL2-8b.

SEQ ID NO: 537 sets forth the full-length *C. trachomatis* serovar D DNA sequence homologous to the *C. trachomatis* LGV II sequence for CT474 identified from the clones CTL2-8b.

SEQ ID NO: 538 sets forth the full-length *C. trachomatis* serovar D DNA sequence homologous to the *C. trachomatis* LGV II sequence for CT139 (oppA1) identified from the clones CTL2-8b.

SEQ ID NO: 539 sets forth the full-length *C. trachomatis* serovar D DNA sequence homologous to the *C. trachomatis* LGV II sequence for CT060 (flhA) identified from the clone CTL2-8b.

SEQ ID NO: 540 sets forth the full-length *C. trachomatis* serovar D DNA sequence homologous to the *C. trachomatis* LGV II sequence for CT242 identified from the clone CTL2gam8.

SEQ ID NO: 541 sets forth the full-length *C. trachomatis* serovar D DNA sequence homologous to the *C. trachomatis* LGV II sequence for CT243 (lpxD) identified from the clone CTL2gam8.

SEQ ID NO: 542 sets forth the full-length *C. trachomatis* serovar D DNA sequence homologous to the *C. trachomatis* LGV II sequence for CT089 identified from the clones CTL2-9, CTL2gam1, CTL2gam17, and CTL2-19(5').

SEQ ID NO: 543 sets forth the full-length *C. trachomatis* serovar D DNA sequence homologous to the *C. trachomatis* LGV II sequence for CT610 identified from the clone CTL2-10 (5')(3').

SEQ ID NO: 544 sets forth the full-length *C. trachomatis* serovar D DNA sequence homologous to the *C. trachomatis* LGV II sequence for CT611 identified from the clone CTL2-10(5').

SEQ ID NO: 545 sets forth the full-length *C. trachomatis* serovar D DNA sequence homologous to the *C. trachomatis* LGV II sequence for CT154 identified from the clones CTL2gam10 and CTL2gam21.

SEQ ID NO: 546 sets forth the full-length *C. trachomatis* serovar D DNA sequence homologous to the *C. trachomatis* LGV II sequence for CT833 (infC) identified from the clone CTL2-12.

SEQ ID NO: 547 sets forth the full-length *C. trachomatis* serovar D DNA sequence homologous to the *C. trachomatis* LGV II sequence for CT827 (nrdA) identified from the clones CTL2-16(3') and CTL2gam15(3').

SEQ ID NO: 548 sets forth the full-length *C. trachomatis* serovar D DNA sequence homologous to the *C. trachomatis* LGV II sequence for CT828 (nrdB) identified from the clones CTL2-16(3') and CTL2gam15(3').

SEQ ID NO: 549 sets forth the full-length *C. trachomatis* serovar D DNA sequence homologous to the *C. trachomatis* LGV II sequence for CT067 (ytgA) identified from the clone CTL2gam18.

SEQ ID NO: 550 sets forth the full-length *C. trachomatis* serovar D DNA sequence homologous to the *C. trachomatis* LGV II sequence for CT088 (sycE) identified from the clones CTL2-19(5').

SEQ ID NO: 551 sets forth the full-length *C. trachomatis* serovar D DNA sequence homologous to the *C. trachomatis* LGV II sequence for CT087 identified from the clone CTL2-19(5').

SEQ ID NO: 552 sets forth the full-length *C. trachomatis* serovar D DNA sequence homologous to the *C. trachomatis* LGV II sequence for CT588 (rsbu) identified from the clone CTL2gam23.

SEQ ID NO: 553 sets forth the full-length *C. trachomatis* serovar D DNA sequence homologous to the *C. trachomatis* LGV II sequence for CT199 (oppB1) identified from the clone CTL2gam24.

SEQ ID NO: 554 sets forth the full-length *C. trachomatis* serovar D DNA sequence homologous to the *C. trachomatis* LGV II sequence for CT545 (dnaE) identified from the clone CTL2-4.

SEQ ID NO: 555 sets forth the full-length *C. trachomatis* serovar D DNA sequence homologous to the *C. trachomatis* LGV II sequence for CT288 identified from the clones CTL2gam27.

SEQ ID NO: 556 sets forth the full-length *C. trachomatis* serovar D DNA sequence homologous to the *C. trachomatis* LGV II sequence for CT413 (pmpB) identified from the clone CTL2gam30(5')(3').

SEQ ID NO: 557 sets forth the full-length *C. trachomatis* serovar D DNA sequence homologous to the *C. trachomatis* LGV II sequence for CT-ORF3 identified from the clones CTL2gam15(5'), CTL2-16(5'), CTL2-18(5') and CTL2-23.

SEQ ID NO: 558 sets forth the full-length *C. trachomatis* serovar D DNA sequence homologous to the *C. trachomatis* LGV II sequence for pCT-ORF4 identified from the clone CTL2-18(3').

SEQ ID NO: 559 sets forth the full-length *C. trachomatis* serovar D DNA sequence homologous to the *C. trachomatis* LGV II sequence for CT-ORF5 identified from the clones CTL2-18(3').

SEQ ID NO: 560 sets forth the full-length *C. trachomatis* serovar D amino acid sequence homologous to the *C. trachomatis* LGV II sequence for CT751 (amn) identified from the clones CTL2-1 and CTL2-5.

SEQ ID NO: 561 sets forth the full-length *C. trachomatis* serovar D amino acid sequence homologous to the *C. trachomatis* LGV II sequence for CT322 (tuff) identified from the clone CTL2-2.

SEQ ID NO: 562 sets forth the full-length *C. trachomatis* serovar D amino acid sequence homologous to the *C. trachomatis* LGV II sequence for CT032 (metG) identified from the clones CTL2gam2, CTL2-3(5') and CTL2-4.

SEQ ID NO: 563 sets forth the full-length *C. trachomatis* serovar D amino acid sequence homologous to the *C. trachomatis* LGV II sequence for CT031 identified from the clone CTL2-3(5')(3').

SEQ ID NO: 564 sets forth the full-length *C. trachomatis* serovar D amino acid sequence homologous to the *C. trachomatis* LGV II sequence for CT030 (gmK) identified from the clones CTL2-3(3') and CTL2-21.

SEQ ID NO: 565 sets forth the full-length *C. trachomatis* serovar D amino acid sequence homologous to the *C. trachomatis* LGV II sequence for CT064 (lepA) identified from the clone CTL2gam5.

SEQ ID NO: 566 sets forth the full-length *C. trachomatis* serovar D amino acid sequence homologous to the *C. trachomatis* LGV II sequence for CT265 (accA) identified from the clone CTL2-6.

SEQ ID NO: 567 sets forth the full-length *C. trachomatis* serovar D amino acid sequence homologous to the *C. trachomatis* LGV II sequence for CT624 (msbA) identified from the clones CTL2-6.

SEQ ID NO: 568 sets forth the full-length *C. trachomatis* serovar D amino acid sequence homologous to the *C. trachomatis* LGV II sequence for CT256 identified from the clones CTL2gam6(5') and CTL2-11(5').

SEQ ID NO: 569 sets forth the full-length *C. trachomatis* serovar D amino acid sequence homologous to the *C. trachomatis* LGV II sequence for CT257 identified from the clones CTL2gam6(5') and CTL2-11(5').

SEQ ID NO: 570 sets forth the full-length *C. trachomatis* serovar D amino acid sequence homologous to the *C. trachomatis* LGV II sequence for CT384 identified from the clones CTL2gam6(3') and CTL2-11(3').

SEQ ID NO: 571 sets forth the full-length *C. trachomatis* serovar D amino acid sequence homologous to the *C. trachomatis* LGV II sequence for CT473 identified from the clone CTL2-8b.

SEQ ID NO: 572 sets forth the full-length *C. trachomatis* serovar D amino acid sequence homologous to the *C. trachomatis* LGV II sequence for CT474 identified from the clones CTL2-8b.

SEQ ID NO: 573 sets forth the full-length *C. trachomatis* serovar D amino acid sequence homologous to the *C. trachomatis* LGV II sequence for CT139 (oppA1) identified from the clones CTL2-8b.

SEQ ID NO: 574 sets forth the full-length *C. trachomatis* serovar D amino acid sequence homologous to the *C. trachomatis* LGV II sequence for CT060 (flhA) identified from the clone CTL2-8b.

SEQ ID NO: 575 sets forth the full-length *C. trachomatis* serovar D amino acid sequence homologous to the *C. trachomatis* LGV II sequence for CT242 identified from the clone CTL2gam8.

SEQ ID NO: 576 sets forth the full-length *C. trachomatis* serovar D amino acid sequence homologous to the *C. trachomatis* LGV II sequence for CT243 (lpxD) identified from the clone CTL2gam8.

SEQ ID NO: 577 sets forth the full-length *C. trachomatis* serovar D amino acid sequence homologous to the *C. trachomatis* LGV II sequence for CT089 identified from the clones CTL2-9, CTL2gam1, CTL2gam17, and CTL2-19(5').

SEQ ID NO: 578 sets forth the full-length *C. trachomatis* serovar D amino acid sequence homologous to the *C. trachomatis* LGV II sequence for CT610 identified from the clone CTL2-10 (5')(3').

SEQ ID NO: 579 sets forth the full-length *C. trachomatis* serovar D amino acid sequence homologous to the *C. trachomatis* LGV II sequence for CT611 identified from the clone CTL2-10(5').

SEQ ID NO: 580 sets forth the full-length *C. trachomatis* serovar D amino acid sequence homologous to the *C. trachomatis* LGV II sequence for CT154 identified from the clones CTL2gam10 and CTL2gam21.

SEQ ID NO: 581 sets forth the full-length *C. trachomatis* serovar D amino acid sequence homologous to the *C. trachomatis* LGV II sequence for CT833 (infC) identified from the clone CTL2-12.

SEQ ID NO: 582 sets forth the full-length *C. trachomatis* serovar D DNA sequence homologous to the *C. trachomatis* LGV II sequence for CT-ORF3 identified from the clones CTL2gam15(5'), CTL2-16(5'), CTL2-18(5') and CTL2-23.

SEQ ID NO: 583 sets forth the full-length *C. trachomatis* serovar D DNA sequence homologous to the *C. trachomatis* LGV II sequence for CT827 (nrdA) identified from the clones CTL2-16(3') and CTL2gam15(3').

SEQ ID NO: 584 sets forth the full-length *C. trachomatis* serovar D DNA sequence homologous to the *C. trachomatis* LGV II sequence for CT828 (nrdB) identified from the clones CTL2-16(3') and CTL2gam15(3').

SEQ ID NO: 585 sets forth the full-length *C. trachomatis* serovar D DNA sequence homologous to the *C. trachomatis* LGV II sequence for CT067 (ytgA) identified from the clone CTL2gam18.

SEQ ID NO: 586 sets forth the full-length *C. trachomatis* serovar D DNA sequence homologous to the *C. trachomatis* LGV II sequence for pCT-ORF4 identified from the clone CTL2-18(3')

SEQ ID NO: 587 sets forth the full-length *C. trachomatis* serovar D DNA sequence homologous to the *C. trachomatis* LGV II sequence for CT-ORF5 identified from the clones CTL2-18(3').

SEQ ID NO: 588 sets forth the full-length *C. trachomatis* serovar D DNA sequence homologous to the *C. trachomatis* LGV II sequence for CT087 identified from the clone CTL2-19(5').

SEQ ID NO: 589 sets forth the full-length *C. trachomatis* serovar D DNA sequence homologous to the *C. trachomatis* LGV II sequence for CT088 (sycE) identified from the clones CTL2-19(5').

SEQ ID NO: 590 sets forth the full-length *C. trachomatis* serovar D DNA sequence homologous to the *C. trachomatis* LGV II sequence for CT588 (rsbu) identified from the clone CTL2gam23.

SEQ ID NO: 591 sets forth the full-length *C. trachomatis* serovar D DNA sequence homologous to the *C. trachomatis* LGV II sequence for CT199 (oppB1) identified from the clone CTL2gam24.

SEQ ID NO: 592 sets forth the full-length *C. trachomatis* serovar D DNA sequence homologous to the *C. trachomatis* LGV II sequence for CT545 (dnaE) identified from the clone CTL2-4.

SEQ ID NO: 593 sets forth the full-length *C. trachomatis* serovar D DNA sequence homologous to the *C. trachomatis* LGV II sequence for CT288 identified from the clones CTL2gam27.

SEQ ID NO: 594 sets forth the full-length *C. trachomatis* serovar D DNA sequence homologous to the *C. trachomatis* LGV II sequence for CT413 (pmpB) identified from the clone CTL2gam30(5')(3').

SEQ ID NO: 595 sets forth the DNA sequence for the *Chlamydia pneumoniae* homologue, CPn0406, of the *Chlamydia trachomatis* gene CT102.

SEQ ID NO: 596 sets forth the DNA sequence for the *Chlamydia pneumoniae* homologue, CPn0315, of the *Chlamydia trachomatis* gene CT098.

SEQ ID NO: 597 sets forth the amino acid sequence for the *Chlamydia pneumoniae* homologue, CPn0406, of the *Chlamydia trachomatis* gene CT102.

SEQ ID NO: 598 sets forth the amino acid sequence for the *Chlamydia pneumoniae* homologue, CPn0315, of the *Chlamydia trachomatis* gene CT098.

SEQ ID NO: 599 sets forth the amino acid sequence for *Chlamydia trachomatis* serovar D CT287 protein.

DESCRIPTION OF THE FIGURES

FIG. 2 illustrates retroviral vectors pBIB-KS1,2,3 modified to contain a Kosak translation initiation site and stop codons (SEQ ID NOS: 600-605).

FIG. 6 illustrates the 5' and 3' primer sequences (SEQ ID NOS: 35-38) designed from *C. pneumoniae* which were used to isolate the SWIB and S13 genes from *C. pneumoniae*.

DETAILED DESCRIPTION OF THE INVENTION

Figure 1:
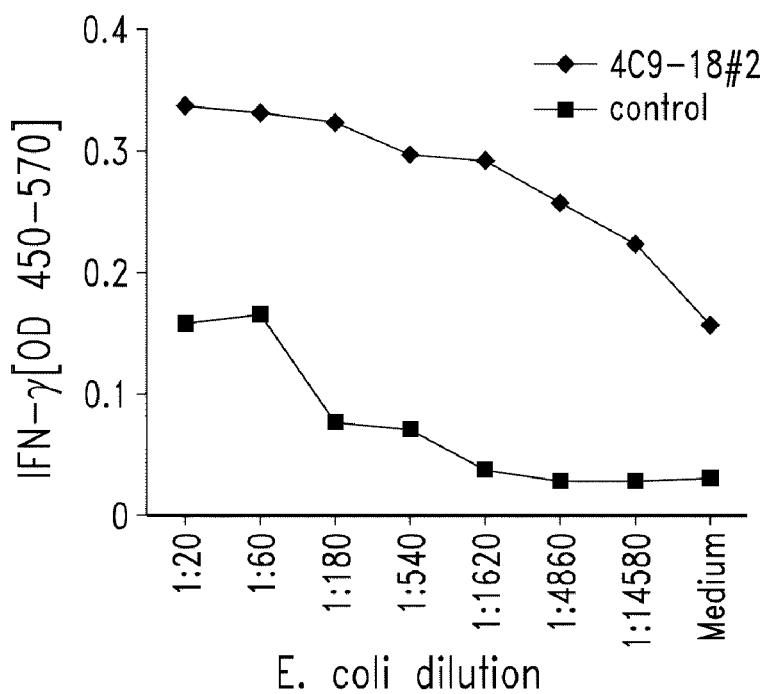
FIG. 1 illustrates induction of INF-γ from a *Chlamydia*-specific T cell line activated by target cells expressing clone 4C9-18#2.

As noted above, the present invention is generally directed to compositions and methods for the diagnosis and treatment of Chlamydial infection. In one aspect, the compositions of the subject invention include polypeptides that comprise at least one immunogenic portion of a *Chlamydia* antigen, or a variant thereof.

In specific embodiments, the subject invention discloses polypeptides comprising an immunogenic portion of a *Chlamydia* antigen, wherein the *Chlamydia* antigen comprises an amino acid sequence encoded by a polynucleotide molecule disclosed herein, the complements of said nucleotide sequences, and variants of such sequences.

As used herein, the term "polypeptide" encompasses amino acid chains of any length, including full length proteins (i.e., antigens), wherein the amino acid residues are linked by covalent peptide bonds. Thus, a polypeptide comprising an immunogenic portion of one of the inventive antigens may consist entirely of the immunogenic portion, or may contain additional sequences. The additional sequences may be derived from the native *Chlamydia* antigen or may be heterologous, and such sequences may (but need not) be immunogenic.

The term "polynucleotide(s)," as used herein, means a single or double-stranded polymer of deoxyribonucleotide or ribonucleotide bases and includes DNA and corresponding RNA molecules, including HnRNA and mRNA molecules, both sense and anti-sense strands, and comprehends cDNA, genomic DNA and recombinant DNA, as well as wholly or partially synthesized polynucleotides. An HnRNA molecule contains introns and corresponds to a DNA molecule in a generally one-to-one manner. An mRNA molecule corresponds to an HnRNA and DNA molecule from which the introns have been excised. A polynucleotide may consist of an entire gene, or any portion thereof. Operable anti-sense polynucleotides may comprise a fragment of the corresponding polynucleotide, and the definition of "polynucleotide" therefore includes all such operable anti-sense fragments.

An "immunogenic portion" of an antigen is a portion that is capable of reacting with sera obtained from a *Chlamydia*-infected individual (i.e., generates an absorbance reading with sera from infected individuals that is at least three standard deviations above the absorbance obtained with sera from uninfected individuals, in a representative ELISA assay described herein). Such immunogenic portions generally comprise at least about 5 amino acid residues, more preferably at least about 10, and most preferably at least about 20 amino acid residues. Methods for preparing and identifying immunogenic portions of antigens of known sequence are well known in the art and include those summarized in Paul, *Fundamental Immunology*, 3$^{rd}$ ed., Raven Press, 1993, pp. 243-247 and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well known techniques. An immunogenic portion of a native *Chlamydia* protein is a portion that reacts with such antisera and/or T-cells at a level that is not substantially less than the reactivity of the full length polypeptide (e.g., in an ELISA and/or T-cell reactivity assay). Such immunogenic portions may react within such assays at a level that is similar to or greater than the reactivity of the full length polypeptide. Such screens may generally be performed using methods well known to those of ordinary skill in the art, such as those described in Harlow and Lane, *Antibodies: A Laboratory Manual*, Cold Spring Harbor Laboratory, 1988. For example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

Examples of immunogenic portions of antigens contemplated by the present invention include, for example, the T cell stimulating epitopes provided in SEQ ID NO: 9, 10, 18, 19, 31, 39, 93-96, 98, 100-102, 106, 108, 138-140, 158, 167, 168, 246, 247 and 254-256. Polypeptides comprising at least an immunogenic portion of one or more *Chlamydia* antigens as described herein may generally be used, alone or in combination, to detect Chlamydial infection in a patient.

The compositions and methods of the present invention also encompass variants of the above polypeptides and polynucleotide molecules. Such variants include, but are not limited to, naturally occurring allelic variants of the inventive sequences. In particular, variants include other Chlamydiae serovars, such as serovars D, E and F, as well as the several LGV serovars which share homology to the inventive polypeptide and polynucleotide molecules described herein. Preferably, the serovar homologues show 95-99% homology to the corresponding polypeptide sequence(s) described herein.

A polypeptide "variant," as used herein, is a polypeptide that differs from the recited polypeptide only in conservative substitutions and/or modifications, such that the antigenic properties of the polypeptide are retained. In a preferred embodiment, variant polypeptides differ from an identified sequence by substitution, deletion or addition of five amino acids or fewer. Such variants may generally be identified by modifying one of the above polypeptide sequences, and evaluating the antigenic properties of the modified polypeptide using, for example, the representative procedures described herein. In other words, the ability of a variant to react with antigen-specific antisera may be enhanced or unchanged, relative to the native protein, or may be diminished by less than 50%, and preferably less than 20%, relative to the native protein. Such variants may generally be identified by modifying one of the above polypeptide sequences and evaluating the reactivity of the modified polypeptide with antigen-specific antibodies or antisera as described herein. Preferred variants include those in which one or more portions, such as an N-terminal leader sequence or transmembrane domain, have been removed. Other preferred variants include variants in which a small portion (e.g., 1-30 amino acids, preferably 5-15 amino acids) has been removed from the N- and/or C-terminal of the mature protein.

As used herein, a "conservative substitution" is one in which an amino acid is substituted for another amino acid that has similar properties, such that one skilled in the art of peptide chemistry would expect the secondary structure and hydropathic nature of the polypeptide to be substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide. Variants may also, or alternatively, contain other modifications, including the deletion or addition of amino acids that have minimal influence on the antigenic properties, secondary structure and hydropathic nature of the polypeptide. For example, a polypeptide may be conjugated to a signal (or leader) sequence at the N-terminal end of the protein which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

A polynucleotide "variant" is a sequence that differs from the recited nucleotide sequence in having one or more nucleotide deletions, substitutions or additions such that the immunogenicity of the encoded polypeptide is not diminished, relative to the native protein. The effect on the immunogenicity of the encoded polypeptide may generally be assessed as described herein. Such modifications may be readily introduced using standard mutagenesis techniques, such as oligonucleotide-directed site-specific mutagenesis as taught, for example, by Adelman et al. (*DNA*, 2:183, 1983). Nucleotide variants may be naturally occurring allelic variants as discussed below, or non-naturally occurring variants. The polypeptides provided by the present invention include variants that are encoded by polynucleotide sequences which are substantially homologous to one or more of the polynucleotide sequences specifically recited herein. "Substantial homology," as used herein, refers to polynucleotide sequences that are capable of hybridizing under moderately stringent conditions. Suitable moderately stringent conditions include prewashing in a solution of 5×SSC, 0.5% SDS, 1.0 mM EDTA (pH 8.0); hybridizing at 50° C.-65° C., 5×SSC, overnight or, in the event of cross-species homology, at 45° C. with 0.5×SSC; followed by washing twice at 65° C. for 20 minutes with each of 2×, 0.5× and 0.2×SSC containing 0.1% SDS. Such hybridizing polynucleotide sequences are also within the scope of this invention, as are nucleotide sequences that, due to code degeneracy, encode a polypeptide that is the same as a polypeptide of the present invention.

Two nucleotide or polypeptide sequences are said to be "identical" if the sequence of nucleotides or amino acid residues in the two sequences is the same when aligned for maximum correspondence as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) Fast and sensitive multiple sequence alignments on a microcomputer *CABIOS* 5:151-153; Myers, E. W. and Muller W. (1988) Optimal alignments in linear space *CABIOS* 4:11-17; Robinson, E. D. (1971) *Comb. Theor* 11:105; Santou, N. Nes, M. (1987) The neighbor joining method. A new method for reconstructing phylogenetic trees *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) Rapid similarity searches of nucleic acid and protein data banks *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) J. Mol. Biol. 48:443, by the search for similarity methods of Pearson and Lipman (1988) Proc. Natl. Acad. Sci. (U.S.A.) 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One illustrative example of algorithms that are suitable for determining percent sequence identity and sequence similarity are the BLAST and BLAST 2.0 algorithms, which are described in Altschul et al. (1977) Nuc. Acids Res. 25:3389-3402 and Altschul et al. (1990) J. Mol. Biol. 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information (http://www dot ncbi dot nlm dot nih dot gov/) In one illustrative example, cumulative scores can be calculated using, for nucleotide sequences, the parameters M (reward score for a pair of matching residues; always >0) and N (penalty score for mismatching residues; always <0). For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) Proc. Natl. Acad. Sci. USA 89:10915) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide or amino acid sequence in the comparison window may comprise additions or deletions (i.e. gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e. the window size) and multiplying the results by 100 to yield the percentage of sequence identity.

Therefore, the present invention provides polynucleotide and polypeptide sequences having substantial identity to the sequences disclosed herein, for example those comprising at least 50% or more sequence identity, preferably at least 55%, 60%, 65%, 70%, 75%, 80%, 85%, 90%, 95%, 96%, 97%, 98%, or 99% or higher, sequence identity compared to a polynucleotide or polypeptide sequence of this invention using the methods described herein, (e.g., BLAST analysis using standard parameters, as described below). One skilled in this art will recognize that these values can be appropriately adjusted to determine corresponding identity of proteins encoded by two polynucleotide sequences by taking into account codon degeneracy, amino acid similarity, reading frame positioning and the like.

In additional embodiments, the present invention provides isolated polynucleotides or polypeptides comprising various lengths of contiguous stretches of sequence identical to or complementary to one or more of the sequences disclosed herein. For example, polynucleotides and polypeptides encompassed by this invention may comprise at least about 15, 20, 30, 40, 50, 75, 100, 150, 200, 300, 400, 500 or 1000 or more contiguous nucleotides of one or more of the disclosed sequences, as well as all intermediate lengths therebetween. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through the 200-500; 500-1,000, and the like.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative DNA segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

Also included in the scope of the present invention are alleles of the genes encoding the nucleotide sequences recited in herein. As used herein, an "allele" or "allelic sequence" is an alternative form of the gene which may result from at least one mutation in the nucleic acid sequence. Alleles may result in altered mRNAs or polypeptides whose structure or function may or may not be altered. Any given gene may have none, one, or many allelic forms. Common mutational changes which give rise to alleles are generally ascribed to natural deletions, additions, or substitutions of nucleotides. Each of these types of changes may occur alone or in combination with the others, one or more times in a given sequence.

In specific embodiments, the subject invention discloses polypeptides comprising at least an immunogenic portion of a *Chlamydia* antigen (or a variant of such an antigen), that comprises one or more of the amino acid sequences encoded by (a) a polynucleotide sequence selected from the group consisting of SEQ ID NO: 358-361, 407-430, 525-559, 582-598; (b) the complements of such DNA sequences or (c) DNA sequences substantially homologous to a sequence in (a) or (b). As discussed in the Examples below, several of the *Chlamydia* antigens disclosed herein recognize a T cell line that recognizes both *Chlamydia trachomatis* and *Chlamydia pneumoniae* infected monocyte-derived dendritic cells, indicating that they may represent an immunoreactive epitope shared by *Chlamydia trachomatis* and *Chlamydia pneumoniae*. The antigens may thus be employed in a vaccine for both *C. trachomatis* genital tract infections and for *C. pneumonia* infections. Further characterization of these *Chlamydia* antigens from *Chlamydia trachomatis* and *Chlamydia pneumonia* to determine the extent of cross-reactivity is provided in Example 6. Additionally, Example 4 describes cDNA fragments (SEQ ID NO: 15, 16 and 33) isolated from *C. trachomatis* which encode proteins (SEQ ID NO: 17-19 and 32) capable of stimulating a *Chlamydia*-specific murine CD8+ T cell line.

In general, *Chlamydia* antigens, and polynucleotide sequences encoding such antigens, may be prepared using any of a variety of procedures. For example, polynucleotide molecules encoding *Chlamydia* antigens may be isolated from a *Chlamydia* genomic or cDNA expression library by screening with a *Chlamydia*-specific T cell line as described below, and sequenced using techniques well known to those of skill in the art. Additionally, a polynucleotide may be identified, as described in more detail below, by screening a microarray of cDNAs for *Chlamydia*-associated expression (i.e., expression that is at least two fold greater in *Chlamydia*-infected cells than in controls, as determined using a representative assay provided herein). Such screens may be performed using a Synteni microarray (Palo Alto, Calif.) according to the manufacturer's instructions (and essentially as described by Schena et al., *Proc. Natl. Acad. Sci. USA* 93:10614-10619, 1996 and Heller et al., *Proc. Natl. Acad. Sci. USA* 94:2150-2155, 1997). Alternatively, polypeptides may be amplified from cDNA prepared from cells expressing the proteins described herein. Such polynucleotides may be amplified via polymerase chain reaction (PCR). For this approach, sequence-specific primers may be designed based on the sequences provided herein, and may be purchased or synthesized.

Antigens may be produced recombinantly, as described below, by inserting a polynucleotide sequence that encodes the antigen into an expression vector and expressing the antigen in an appropriate host. Antigens may be evaluated for a desired property, such as the ability to react with sera obtained from a *Chlamydia*-infected individual as described herein, and may be sequenced using, for example, traditional Edman chemistry. See Edman and Berg, *Eur. J. Biochem.* 80:116-132, 1967.

Polynucleotide sequences encoding antigens may also be obtained by screening an appropriate *Chlamydia* cDNA or genomic DNA library for polynucleotide sequences that hybridize to degenerate oligonucleotides derived from partial amino acid sequences of isolated antigens. Degenerate oligonucleotide sequences for use in such a screen may be designed and synthesized, and the screen may be performed, as described (for example) in Sambrook et al., *Molecular Cloning: A Laboratory Manual*, Cold Spring Harbor Laboratories, Cold Spring Harbor, N.Y. (and references cited therein). Polymerase chain reaction (PCR) may also be employed, using the above oligonucleotides in methods well known in the art, to isolate a nucleic acid probe from a cDNA or genomic library. The library screen may then be performed using the isolated probe.

An amplified portion may be used to isolate a full length gene from a suitable library (e.g., a *Chlamydia* cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}P$) using well known techniques. A bacterial or bacteriophage library is then screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences are then assembled into a single contiguous sequence. A full length cDNA molecule can be generated by ligating suitable fragments, using well known techniques.

Alternatively, there are numerous amplification techniques for obtaining a full length coding sequence from a partial cDNA sequence. Within such techniques, amplification is generally performed via PCR. Any of a variety of commercially available kits may be used to perform the amplification step. Primers may be designed using techniques well known in the art (see, for example, Mullis et al., *Cold Spring Harbor Symp. Quant. Biol.* 51:263, 1987; Erlich ed., *PCR Technology*, Stockton Press, NY, 1989), and software well known in the art may also be employed. Primers are preferably 22-30 nucleotides in length, have a GC content of at least 50% and anneal to the target sequence at temperatures of about 68° C. to 72° C. The amplified region may be sequenced as described above, and overlapping sequences assembled into a contiguous sequence.

One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Additional techniques include capture PCR (Lagerstrom et al., *PCR Methods Applic.* 1:111-19, 1991) and walking PCR (Parker et al., *Nucl. Acids. Res.* 19:3055-60, 1991). Transcription-Mediated Amplification, or TMA is another method that may be utilized for the amplification of DNA, rRNA, or mRNA, as described in Patent No. PCT/US91/03184. This autocatalytic and isothermic non-PCR based method utilizes two primers and two enzymes: RNA polymerase and reverse transcriptase. One primer contains a promoter sequence for RNA polymerase. In the first amplification, the promoter-primer hybridizes to the target rRNA at a defined site. Reverse transcriptase creates a DNA copy of the target rRNA by extension from the 3' end of the promoter-primer. The RNA in the resulting complex is degraded and a second primer binds to the DNA copy. A new strand of DNA is synthesized from the end of the primer by reverse transcriptase creating double stranded DNA. RNA polymerase recognizes the promoter sequence in the DNA template and initiates transcription. Each of the newly synthesized RNA amplicons re-enters the TMA process and serves as a template for a new round of replication leading to the exponential expansion of the RNA amplicon. Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length cDNA sequences may also be obtained by analysis of genomic fragments.

Polynucleotide variants may generally be prepared by any method known in the art, including chemical synthesis by, for example, solid phase phosphoramidite chemical synthesis. Modifications in a polynucleotide sequence may also be introduced using standard mutagenesis techniques, such as oligonucleotide-directed site-specific mutagenesis (see Adelman et al., *DNA* 2:183, 1983). Alternatively, RNA molecules may be generated by in vitro or in vivo transcription of DNA sequences encoding a Chlamydial protein, or portion thereof, provided that the DNA is incorporated into a vector with a suitable RNA polymerase promoter (such as T7 or SP6). Certain portions may be used to prepare an encoded polypeptide, as described herein. In addition, or alternatively, a portion may be administered to a patient such that the encoded polypeptide is generated in vivo (e.g., by transfecting antigen-presenting cells, such as dendritic cells, with a cDNA construct encoding a Chlamydial polypeptide, and administering the transfected cells to the patient).

A portion of a sequence complementary to a coding sequence (i.e., an antisense polynucleotide) may also be used as a probe or to modulate gene expression. cDNA constructs that can be transcribed into antisense RNA may also be introduced into cells of tissues to facilitate the production of antisense RNA. An antisense polynucleotide may be used, as described herein, to inhibit expression of a Chlamydial protein. Antisense technology can be used to control gene expression through triple-helix formation, which compromises the ability of the double helix to open sufficiently for the binding of polymerases, transcription factors or regulatory molecules (see Gee et al., In Huber and Carr, *Molecular and Immunologic Approaches*, Futura Publishing Co. (Mt. Kisco, N.Y.; 1994)). Alternatively, an antisense molecule may be designed to hybridize with a control region of a gene (e.g., promoter, enhancer or transcription initiation site), and block transcription of the gene; or to block translation by inhibiting binding of a transcript to ribosomes.

A portion of a coding sequence, or of a complementary sequence, may also be designed as a probe or primer to detect gene expression. Probes may be labeled with a variety of reporter groups, such as radionuclides and enzymes, and are preferably at least 10 nucleotides in length, more preferably at least 20 nucleotides in length and still more preferably at least 30 nucleotides in length. Primers, as noted above, are preferably 22-30 nucleotides in length.

Any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-, methyl-, thio- and other modified forms of adenine, cytidine, guanine, thymine and uridine.

Nucleotide sequences as described herein may be joined to a variety of other nucleotide sequences using established recombinant DNA techniques. For example, a polynucleotide may be cloned into any of a variety of cloning vectors, including plasmids, phagemids, lambda phage derivatives and cosmids. Vectors of particular interest include expression vectors, replication vectors, probe generation vectors and sequencing vectors. In general, a vector will contain an origin of replication functional in at least one organism, convenient restriction endonuclease sites and one or more selectable markers. Other elements will depend upon the desired use, and will be apparent to those of ordinary skill in the art.

Synthetic polypeptides having fewer than about 100 amino acids, and generally fewer than about 50 amino acids, may be generated using techniques well known in the art. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149-2146, 1963. Equipment for automated synthesis of polypeptides is commercially available from suppliers such as Perkin Elmer/Applied BioSystems Division, Foster City, Calif., and may be operated according to the manufacturer's instructions.

As noted above, immunogenic portions of *Chlamydia* antigens may be prepared and identified using well known techniques, such as those summarized in Paul, *Fundamental Immunology*, 3d ed., Raven Press, 1993, pp. 243-247 and references cited therein. Such techniques include screening polypeptide portions of the native antigen for immunogenic properties. The representative ELISAs described herein may generally be employed in these screens. An immunogenic portion of a polypeptide is a portion that, within such representative assays, generates a signal in such assays that is substantially similar to that generated by the full length antigen. In other words, an immunogenic portion of a *Chlamydia* antigen generates at least about 20%, and preferably about 100%, of the signal induced by the full length antigen in a model ELISA as described herein.

Portions and other variants of *Chlamydia* antigens may be generated by synthetic or recombinant means. Variants of a native antigen may generally be prepared using standard mutagenesis techniques, such as oligonucleotide-directed site-specific mutagenesis. Sections of the polynucleotide sequence may also be removed using standard techniques to permit preparation of truncated polypeptides.

Recombinant polypeptides containing portions and/or variants of a native antigen may be readily prepared from a polynucleotide sequence encoding the polypeptide using a variety of techniques well known to those of ordinary skill in the art. For example, supernatants from suitable host/vector systems which secrete recombinant protein into culture media may be first concentrated using a commercially available filter. Following concentration, the concentrate may be applied to a suitable purification matrix such as an affinity matrix or an ion exchange resin. Finally, one or more reverse phase HPLC steps can be employed to further purify a recombinant protein.

Any of a variety of expression vectors known to those of ordinary skill in the art may be employed to express recombinant polypeptides as described herein. Expression may be achieved in any appropriate host cell that has been transformed or transfected with an expression vector containing a polynucleotide molecule that encodes a recombinant polypeptide. Suitable host cells include prokaryotes, yeast and higher eukaryotic cells. Preferably, the host cells employed are *E. coli*, yeast or a mammalian cell line, such as COS or CHO. The DNA sequences expressed in this manner may encode naturally occurring antigens, portions of naturally occurring antigens, or other variants thereof.

In general, regardless of the method of preparation, the polypeptides disclosed herein are prepared in an isolated, substantially pure, form. Preferably, the polypeptides are at least about 80% pure, more preferably at least about 90% pure and most preferably at least about 99% pure.

Within certain specific embodiments, a polypeptide may be a fusion protein that comprises multiple polypeptides as described herein, or that comprises at least one polypeptide as described herein and an unrelated sequence, such as a known Chlamydial protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the protein or to enable the protein to be targeted to desired intracellular compartments. Still further fusion partners include affinity tags, which facilitate purification of the protein. A DNA sequence encoding a fusion protein of the present invention may be constructed using known recombinant DNA techniques to assemble separate DNA sequences encoding, for example, the first and second polypeptides, into an appropriate expression vector. The 3' end of a DNA sequence encoding the first polypeptide is ligated, with or without a peptide linker, to the 5' end of a DNA sequence encoding the second polypeptide so that the reading frames of the sequences are in phase to permit mRNA translation of the two DNA sequences into a single fusion protein that retains the biological activity of both the first and the second polypeptides.

A peptide linker sequence may be employed to separate the first and the second polypeptides by a distance sufficient to ensure that each polypeptide folds into its secondary and tertiary structures. Such a peptide linker sequence is incorporated into the fusion protein using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:39-46, 1985; Murphy et al., *Proc. Natl. Acad. Sci. USA* 83:8258-8562, 1986; U.S. Pat. No. 4,935,233 and U.S. Pat. No. 4,751,180. The linker sequence may be from 1 to about 50 amino acids in length. As an alternative to the use of a peptide linker sequence (when desired), one can utilize non-essential N-terminal amino acid regions (when present) on the first and second polypeptides to separate the functional domains and prevent steric hindrance.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

Fusion proteins are also provided that comprise a polypeptide of the present invention together with an unrelated immunogenic protein. Preferably the immunogenic protein is capable of eliciting a recall response. Examples of such proteins include tetanus, tuberculosis and hepatitis proteins (see, for example, Stoute et al. *New Engl. J. Med.*, 336:86-91, 1997).

Within preferred embodiments, an immunological fusion partner is derived from protein D, a surface protein of the gram-negative bacterium *Haemophilus influenza* B (WO 91/18926). Preferably, a protein D derivative comprises approximately the first third of the protein (e.g., the first N-terminal 100-110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in *E. coli* (thus functioning as an expression enhancer). The lipid tail ensures optimal presentation of the antigen to antigen presenting cells. Other fusion partners include the non-structural protein from influenzae virus, NS1 (hemaglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from *Streptococcus pneumoniae*, which synthesizes an N-acetyl-L-alanine amidase known as amidase LYTA (encoded by the LytA gene; *Gene* 43:265-292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of *E. coli* C-LYTA expressing plasmids useful for expression of fusion proteins. Purification of hybrid proteins containing the C-LYTA fragment at the amino terminus has been described (see *Biotechnology* 10:795-798, 1992). Within a preferred embodiment, a repeat portion of LYTA may be incorporated into a fusion protein. A repeat portion is found in the C-terminal region starting at residue 178. A particularly preferred repeat portion incorporates residues 188-305.

In another embodiment, a *Mycobacterium tuberculosis*-derived Ra12 polynucleotide is linked to at least an immunogenic portion of a polynucleotide of this invention. Ra12 compositions and methods for their use in enhancing expression of heterologous polynucleotide sequences is described in U.S. Patent Application 60/158,585, the disclosure of which is incorporated herein by reference in its entirety. Briefly, Ra12 refers to a polynucleotide region that is a subsequence of a *Mycobacterium tuberculosis* MTB32A nucleic acid. MTB32A is a serine protease of 32 KD molecular weight encoded by a gene in virulent and avirulent strains of *M. tuberculosis*. The nucleotide sequence and amino acid sequence of MTB32A have been described (U.S. Patent Application 60/158,585; see also, Skeiky et al., *Infection and Immun.* (1999) 67:3998-4007, incorporated herein by reference. In one embodiment, the Ra12 polypeptide used in the production of fusion polypeptides comprises a C-terminal fragment of the MTB32A coding sequence that is effective for enhancing the expression and/or immunogenicity of heterologous Chlamydial antigenic polypeptides with which it is fused. In another embodiment, the Ra12 polypeptide corresponds to an approximately 14 kD C-terminal fragment of MTB32A comprising some or all of amino acid residues 192 to 323 of MTB32A.

Recombinant nucleic acids, which encode a fusion polypeptide comprising a Ra12 polypeptide and a heterologous *Chlamydia* polypeptide of interest, can be readily constructed by conventional genetic engineering techniques. Recombinant nucleic acids are constructed so that, preferably, a Ra12 polynucleotide sequence is located 5' to a selected heterologous *Chlamydia* polynucleotide sequence. It may also be appropriate to place a Ra12 polynucleotide sequence 3' to a selected heterologous polynucleotide sequence or to insert a heterologous polynucleotide sequence into a site within a Ra12 polynucleotide sequence.

In addition, any suitable polynucleotide that encodes a Ra12 or a portion or other variant thereof can be used in constructing recombinant fusion polynucleotides comprising Ra12 and one or more *Chlamydia* polynucleotides disclosed herein. Preferred Ra12 polynucleotides generally comprise at least about 15 consecutive nucleotides, at least about 30 nucleotides, at least about 60 nucleotides, at least about 100 nucleotides, at least about 200 nucleotides, or at least about 300 nucleotides that encode a portion of a Ra12 polypeptide.

Ra12 polynucleotides may comprise a native sequence (i.e., an endogenous sequence that encodes a Ra12 polypeptide or a portion thereof) or may comprise a variant of such a sequence. Ra12 polynucleotide variants may contain one or more substitutions, additions, deletions and/or insertions such that the biological activity of the encoded fusion polypeptide is not substantially diminished, relative to a fusion polypeptide comprising a native Ra12 polypeptide. Variants preferably exhibit at least about 70% identity, more preferably at least about 80% identity and most preferably at least about 90% identity to a polynucleotide sequence that encodes a native Ra12 polypeptide or a portion thereof.

In another aspect, the present invention provides methods for using one or more of the above polypeptides or fusion proteins (or polynucleotides encoding such polypeptides or fusion proteins) to induce protective immunity against Chlamydial infection in a patient. As used herein, a "patient" refers to any warm-blooded animal, preferably a human. A patient may be afflicted with a disease, or may be free of detectable disease and/or infection. In other words, protective immunity may be induced to prevent or treat Chlamydial infection.

In this aspect, the polypeptide, fusion protein or polynucleotide molecule is generally present within a pharmaceutical composition or a vaccine. Pharmaceutical compositions may comprise one or more polypeptides, each of which may contain one or more of the above sequences (or variants thereof), and a physiologically acceptable carrier. Vaccines may comprise one or more of the above polypeptides and an immunostimulant, such as an adjuvant or a liposome (into which the polypeptide is incorporated). Such pharmaceutical compositions and vaccines may also contain other *Chlamydia* antigens, either incorporated into a combination polypeptide or present within a separate polypeptide.

Alternatively, a vaccine may contain polynucleotides encoding one or more polypeptides or fusion proteins as described above, such that the polypeptide is generated in situ. In such vaccines, the polynucleotides may be present within any of a variety of delivery systems known to those of ordinary skill in the art, including nucleic acid expression systems, bacterial and viral expression systems. Appropriate nucleic acid expression systems contain the necessary polynucleotide sequences for expression in the patient (such as a suitable promoter and terminating signal). Bacterial delivery systems involve the administration of a bacterium (such as *Bacillus*-Calmette-Guerrin) that expresses an immunogenic portion of the polypeptide on its cell surface. In a preferred embodiment, the polynucleotides may be introduced using a viral expression system (e.g., vaccinia or other pox virus, retrovirus, or adenovirus), which may involve the use of a non-pathogenic (defective) virus. Techniques for incorporating polynucleotides into such expression systems are well known to those of ordinary skill in the art. The polynucleotides may also be administered as "naked" plasmid vectors as described, for example, in Ulmer et al., *Science* 259:1745-1749, 1993 and reviewed by Cohen, *Science* 259:1691-1692, 1993. Techniques for incorporating DNA into such vectors are well known to those of ordinary skill in the art. A retroviral vector may additionally transfer or incorporate a gene for a selectable marker (to aid in the identification or selection of transduced cells) and/or a targeting moiety, such as a gene that encodes a ligand for a receptor on a specific target cell, to render the vector target specific. Targeting may also be accomplished using an antibody, by methods known to those of ordinary skill in the art.

Other formulations for therapeutic purposes include colloidal dispersion systems, such as macromolecule complexes, nanocapsules, microspheres, beads, and lipid-based systems including oil-in-water emulsions, micelles, mixed micelles, and liposomes. A preferred colloidal system for use as a delivery vehicle in vitro and in vivo is a liposome (i.e., an artificial membrane vesicle). The uptake of naked polynucleotides may be increased by incorporating the polynucleotides into and/or onto biodegradable beads, which are efficiently transported into the cells. The preparation and use of such systems is well known in the art.

In a related aspect, a polynucleotide vaccine as described above may be administered simultaneously with or sequentially to either a polypeptide of the present invention or a known *Chlamydia* antigen. For example, administration of polynucleotides encoding a polypeptide of the present invention, either "naked" or in a delivery system as described above, may be followed by administration of an antigen in order to enhance the protective immune effect of the vaccine.

Polypeptides and polynucleotides disclosed herein may also be employed in adoptive immunotherapy for the treatment of Chlamydial infection. Adoptive immunotherapy may be broadly classified into either active or passive immunotherapy. In active immunotherapy, treatment relies on the in vivo stimulation of the endogenous host immune system with the administration of immune response-modifying agents (for example, vaccines, bacterial adjuvants, and/or cytokines).

In passive immunotherapy, treatment involves the delivery of biologic reagents with established immune reactivity (such as effector cells or antibodies) that can directly or indirectly mediate anti-*Chlamydia* effects and does not necessarily depend on an intact host immune system. Examples of effector cells include T lymphocytes (for example, CD8+ cytotoxic T-lymphocyte, CD4+ T-helper), killer cells (such as Natural Killer cells, lymphokine-activated killer cells), B cells, or antigen presenting cells (such as dendritic cells and macrophages) expressing the disclosed antigens. The polypeptides disclosed herein may also be used to generate antibodies or anti-idiotypic antibodies (as in U.S. Pat. No. 4,918,164), for passive immunotherapy.

The predominant method of procuring adequate numbers of T-cells for adoptive immunotherapy is to grow immune T-cells in vitro. Culture conditions for expanding single antigen-specific T-cells to several billion in number with retention of antigen recognition in vivo are well known in the art. These in vitro culture conditions typically utilize intermittent stimulation with antigen, often in the presence of cytokines, such as IL-2, and non-dividing feeder cells. As noted above, the immunoreactive polypeptides described herein may be used to rapidly expand antigen-specific T cell cultures in order to generate sufficient number of cells for immunotherapy. In particular, antigen-presenting cells, such as dendritic, macrophage, monocyte, fibroblast, or B-cells, may be pulsed with immunoreactive polypeptides, or polynucleotide sequence(s) may be introduced into antigen presenting cells, using a variety of standard techniques well known in the art. For example, antigen presenting cells may be transfected or transduced with a polynucleotide sequence, wherein said sequence contains a promoter region appropriate for increasing expression, and can be expressed as part of a recombinant virus or other expression system. Several viral vectors may be used to transduce an antigen presenting cell, including pox virus, vaccinia virus, and adenovirus; also, antigen presenting cells may be transfected with polynucleotide sequences disclosed herein by a variety of means, including gene-gun technology, lipid-mediated delivery, electroporation, osmotic shock, and particulate delivery mechanisms, resulting in efficient and acceptable expression levels as determined by one of ordinary skill in the art. For cultured T-cells to be effective in therapy, the cultured T-cells must be able to grow and distribute widely and to survive long term in vivo. Studies have demonstrated that cultured T-cells can be induced to grow in vivo and to survive long term in substantial numbers by repeated stimulation with antigen supplemented with IL-2 (see, for example, Cheever, M., et al, "Therapy With Cultured T Cells: Principles Revisited," *Immunological Reviews*, 157: 177, 1997).

The polypeptides disclosed herein may also be employed to generate and/or isolate chlamydial-reactive T-cells, which can then be administered to the patient. In one technique, antigen-specific T-cell lines may be generated by in vivo immunization with short peptides corresponding to immunogenic portions of the disclosed polypeptides. The resulting antigen specific CD8+ or CD4+ T-cell clones may be isolated from the patient, expanded using standard tissue culture techniques, and returned to the patient.

Alternatively, peptides corresponding to immunogenic portions of the polypeptides may be employed to generate *Chlamydia* reactive T cell subsets by selective in vitro stimulation and expansion of autologous T cells to provide antigen-specific T cells which may be subsequently transferred to the patient as described, for example, by Chang et al, (*Crit. Rev. Oncol. Hematol.*, 22(3), 213, 1996). Cells of the immune system, such as T cells, may be isolated from the peripheral blood of a patient, using a commercially available cell separation system, such as Isolex™ System, available from Nexell Therapeutics, Inc. Irvine, Calif. The separated cells are stimulated with one or more of the immunoreactive polypeptides contained within a delivery vehicle, such as a microsphere, to provide antigen-specific T cells. The population of antigen-specific T cells is then expanded using standard techniques and the cells are administered back to the patient.

In other embodiments, T-cell and/or antibody receptors specific for the polypeptides disclosed herein can be cloned, expanded, and transferred into other vectors or effector cells for use in adoptive immunotherapy. In particular, T cells may be transfected with the appropriate genes to express the variable domains from chlamydia specific monoclonal antibodies as the extracellular recognition elements and joined to the T cell receptor signaling chains, resulting in T cell activation, specific lysis, and cytokine release. This enables the T cell to redirect its specificity in an MHC-independent manner. See for example, Eshhar, Z., *Cancer Immunol Immunother,* 45(3-4):131-6, 1997 and Hwu, P., et al, *Cancer Res,* 55(15):3369-73, 1995. Another embodiment may include the transfection of chlamydia antigen specific alpha and beta T cell receptor chains into alternate T cells, as in Cole, D J, et al, *Cancer Res,* 55(4):748-52, 1995.

In a further embodiment, syngeneic or autologous dendritic cells may be pulsed with peptides corresponding to at least an immunogenic portion of a polypeptide disclosed herein. The resulting antigen-specific dendritic cells may either be transferred into a patient, or employed to stimulate T cells to provide antigen-specific T cells which may, in turn, be administered to a patient. The use of peptide-pulsed dendritic cells to generate antigen-specific T cells and the subsequent use of such antigen-specific T cells to eradicate disease in a murine model has been demonstrated by Cheever et al, *Immunological Reviews,* 157:177, 1997). Additionally, vectors expressing the disclosed polynucleotides may be introduced into stem cells taken from the patient and clonally propagated in vitro for autologous transplant back into the same patient.

Within certain aspects, polypeptides, polynucleotides, T cells and/or binding agents disclosed herein may be incorporated into pharmaceutical compositions or immunogenic compositions (i.e., vaccines). Alternatively, a pharmaceutical composition may comprise an antigen-presenting cell (e.g. a dendritic cell) transfected with a Chlamydial polynucleotide such that the antigen presenting cell expresses a Chlamydial polypeptide. Pharmaceutical compositions comprise one or more such compounds and a physiologically acceptable carrier. Vaccines may comprise one or more such compounds and an immunostimulant. An immunostimulant may be any substance that enhances or potentiates an immune response to an exogenous antigen. Examples of immunostimulants include adjuvants, biodegradable microspheres (e.g., polylactic galactide) and liposomes (into which the compound is incorporated; see e.g., Fullerton, U.S. Pat. No. 4,235,877). Vaccine preparation is generally described in, for example, M. F. Powell and M. J. Newman, eds., "Vaccine Design (the subunit and adjuvant approach)," Plenum Press (NY, 1995). Pharmaceutical compositions and vaccines within the scope of the present invention may also contain other compounds, which may be biologically active or inactive. For example, one or more immunogenic portions of other Chlamydial antigens may be present, either incorporated into a fusion polypeptide or as a separate compound, within the composition or vaccine.

A pharmaceutical composition or vaccine may contain DNA encoding one or more of the polypeptides as described above, such that the polypeptide is generated in situ. As noted above, the DNA may be present within any of a variety of delivery systems known to those of ordinary skill in the art, including nucleic acid expression systems, bacteria and viral expression systems. Numerous gene delivery techniques are well known in the art, such as those described by Rolland, *Crit. Rev. Therap. Drug Carrier Systems* 15:143-198, 1998, and references cited therein. Appropriate nucleic acid expression systems contain the necessary DNA sequences for expression in the patient (such as a suitable promoter and terminating signal). Bacterial delivery systems involve the administration of a bacterium (such as *Bacillus*-Calmette-Guerrin) that expresses an immunogenic portion of the polypeptide on its cell surface or secretes such an epitope.

In a preferred embodiment, the DNA may be introduced using a viral expression system (e.g., vaccinia or other pox virus, retrovirus, adenovirus, baculovirus, togavirus, bacteriophage, and the like), which often involves the use of a non-pathogenic (defective), replication competent virus.

For example, many viral expression vectors are derived from viruses of the retroviridae family. This family includes the murine leukemia viruses, the mouse mammary tumor viruses, the human foamy viruses, Rous sarcoma virus, and the immunodeficiency viruses, including human, simian, and feline. Considerations when designing retroviral expression vectors are discussed in Comstock et al. (1997).

Excellent murine leukemia virus (MLV)-based viral expression vectors have been developed by Kim et al. (1998). In creating the MLV vectors, Kim et al found that the entire gag sequence, together with the immediate upstream region, could be deleted without significantly affecting viral packaging or gene expression. Further, it was found that nearly the entire U3 region could be replaced with the immediately-early promoter of human cytomegalovirus without deleterious effects. Additionally, MCR and internal ribosome entry sites (IRES) could be added without adverse effects. Based on their observations, Kim et al. have designed a series of MLV-based expression vectors comprising one or more of the features described above.

As more has been learned about human foamy virus (HFV), characteristics of HFV that are favorable for its use as an expression vector have been discovered. These characteristics include the expression of pol by splicing and start of translation at a defined initiation codon. Other aspects of HFV viral expression vectors are reviewed in Bodem et al. (1997).

Murakami et al. (1997) describe a Rous sarcoma virus (RSV)-based replication-competent avian retrovirus vectors, IR1 and IR2 to express a heterologous gene at a high level. In these vectors, the IRES derived from encephalomyocarditis virus (EMCV) was inserted between the env gene and the heterologous gene. The IR1 vector retains the splice-acceptor site that is present downstream of the env gene while the IR2 vector lacks it. Murakami et al. have shown high level expression of several different heterologous genes by these vectors.

Recently, a number of lentivirus-based retroviral expression vectors have been developed. Kafri et al. (1997) have shown sustained expression of genes delivered directly into liver and muscle by a human immunodeficiency virus (HIV)-based expression vector. One benefit of the system is the inherent ability of HIV to transduce non-dividing cells. Because the viruses of Kafri et al. are pseudotyped with vesicular stomatitis virus G glycoprotein (VSVG), they can transduce a broad range of tissues and cell types.

A large number of adenovirus-based expression vectors have been developed, primarily due to the advantages offered by these vectors in gene therapy applications. Adenovirus expression vectors and methods of using such vectors are the subject of a number of United States patents, including U.S. Pat. No. 5,698,202, U.S. Pat. No. 5,616,326, U.S. Pat. No. 5,585,362, and U.S. Pat. No. 5,518,913, all incorporated herein by reference.

Additional adenoviral constructs are described in Khatri et al. (1997) and Tomanin et al. (1997). Khatri et al. describe novel ovine adenovirus expression vectors and their ability to infect bovine nasal turbinate and rabbit kidney cells as well as a range of human cell type, including lung and foreskin fibroblasts as well as liver, prostate, breast, colon and retinal lines. Tomanin et al. describe adenoviral expression vectors containing the T7 RNA polymerase gene. When introduced into cells containing a heterologous gene operably linked to a T7 promoter, the vectors were able to drive gene expression from the T7 promoter. The authors suggest that this system may be useful for the cloning and expression of genes encoding cytotoxic proteins.

Poxviruses are widely used for the expression of heterologous genes in mammalian cells. Over the years, the vectors have been improved to allow high expression of the heterologous gene and simplify the integration of multiple heterologous genes into a single molecule. In an effort to diminish cytopathic effects and to increase safety, vaccinia virus mutant and other poxviruses that undergo abortive infection in mammalian cells are receiving special attention (Oertli et al., 1997). The use of poxviruses as expression vectors is reviewed in Carroll and Moss (1997).

Togaviral expression vectors, which includes alphaviral expression vectors have been used to study the structure and function of proteins and for protein production purposes. Attractive features of togaviral expression vectors are rapid and efficient gene expression, wide host range, and RNA genomes (Huang, 1996). Also, recombinant vaccines based on alphaviral expression vectors have been shown to induce a strong humoral and cellular immune response with good immunological memory and protective effects (Tubulekas et al., 1997). Alphaviral expression vectors and their use are discussed, for example, in Lundstrom (1997).

In one study, L1 and Garoff (1996) used Semliki Forest virus (SFV) expression vectors to express retroviral genes and to produce retroviral particles in BHK-21 cells. The particles produced by this method had protease and reverse transcriptase activity and were infectious. Furthermore, no helper virus could be detected in the virus stocks. Therefore, this system has features that are attractive for its use in gene therapy protocols.

Baculoviral expression vectors have traditionally been used to express heterologous proteins in insect cells. Examples of proteins include mammalian chemokine receptors (Wang et al., 1997), reporter proteins such as green fluorescent protein (Wu et al., 1997), and FLAG fusion proteins (Wu et al., 1997; Koh et al., 1997). Recent advances in baculoviral expression vector technology, including their use in virion display vectors and expression in mammalian cells is reviewed by Possee (1997). Other reviews on baculoviral expression vectors include Jones and Morikawa (1996) and O'Reilly (1997).

Other suitable viral expression systems are disclosed, for example, in Fisher-Hoch et al., *Proc. Natl. Acad. Sci. USA* 86:317-321, 1989; Flexner et al., *Ann. N.Y. Acad. Sci.* 569: 86-103, 1989; Flexner et al., *Vaccine* 8:17-21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616-627, 1988; Rosenfeld et al., *Science* 252:431-434, 1991; Kolls et al., *Proc. Natl. Acad. Sci. USA* 91:215-219, 1994; Kass-Eisler et al., *Proc. Natl. Acad. Sci. USA* 90:11498-11502, 1993; Guzman et al., *Circulation* 88:2838-2848, 1993; and Guzman et al., *Cir. Res.* 73:1202-1207, 1993. Techniques for incorporating DNA into such expression systems are well known to those of ordinary skill in the art. In other systems, the DNA may be introduced as "naked" DNA, as described, for example, in Ulmer et al., *Science* 259:1745-1749, 1993 and reviewed by Cohen, *Science* 259:1691-1692, 1993. The uptake of naked DNA may be increased by coating the DNA onto biodegradable beads, which are efficiently transported into the cells.

It will be apparent that a vaccine may comprise a polynucleotide and/or a polypeptide component, as desired. It will also be apparent that a vaccine may contain pharmaceutically acceptable salts of the polynucleotides and/or polypeptides provided herein. Such salts may be prepared from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts). While any suitable carrier known to those of ordinary skill in the art may be employed in the pharmaceutical compositions of this invention, the type of carrier will vary depending on the mode of administration. Compositions of the present invention may be formulated for any appropriate manner of administration, including for example, topical, oral, nasal, intravenous, intracranial, intraperitoneal, subcutaneous or intramuscular administration. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactate polyglycolate) may also be employed as carriers for the pharmaceutical compositions of this invention. Suitable biodegradable microspheres are disclosed, for example, in U.S. Pat. Nos. 4,897,268 and 5,075,109.

Such compositions may also comprise buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate. Compounds may also be encapsulated within liposomes using well known technology.

Any of a variety of immunostimulants may be employed in the vaccines of this invention. For example, an adjuvant may be included. Most adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Suitable adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF or interleukin-2, -7, or -12, may also be used as adjuvants.

Within the vaccines provided herein, under select circumstances, the adjuvant composition may be designed to induce an immune response predominantly of the Th1 type or Th2 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffman, *Ann. Rev. Immunol.* 7:145-173, 1989.

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Corixa Corporation (Seattle, Wash.; see U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555 and WO 99/33488. Immunostimulatory DNA sequences are also described, for example, by Sato et al., *Science* 273:352, 1996. Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other preferred formulations comprise an oil-in-water emulsion and tocopherol. A particularly potent adjuvant formulation involving QS21, 3D-MPL and tocopherol in an oil-in-water emulsion is described in WO 95/17210.

Other preferred adjuvants include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Corixa Corporation; Seattle, Wash.), RC-529 (Corixa Corporation; Seattle, Wash.) and other aminoalkyl glucosaminide 4-phosphates (AGPs), such as those described in pending U.S. patent application Ser. Nos. 08/853,826 and 09/074,720, the disclosures of which are incorporated herein by reference in their entireties.

Any vaccine provided herein may be prepared using well known methods that result in a combination of antigen, immunostimulant and a suitable carrier or excipient. The compositions described herein may be administered as part of a sustained release formulation (i.e., a formulation such as a capsule, sponge or gel (composed of polysaccharides, for example) that effects a slow release of compound following administration). Such formulations may generally be prepared using well known technology (see, e.g., Coombes et al., *Vaccine* 14:1429-1438, 1996) and administered by, for example, oral, rectal or subcutaneous implantation, or by implantation at the desired target site. Sustained-release formulations may contain a polypeptide, polynucleotide or antibody dispersed in a carrier matrix and/or contained within a reservoir surrounded by a rate controlling membrane.

Carriers for use within such formulations are biocompatible, and may also be biodegradable; preferably the formulation provides a relatively constant level of active component release. Such carriers include microparticles of poly(lactide-co-glycolide), as well as polyacrylate, latex, starch, cellulose and dextran. Other delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

Any of a variety of delivery vehicles may be employed within pharmaceutical compositions and vaccines to facilitate production of an antigen-specific immune response that targets *Chlamydia*-infected cells. Delivery vehicles include antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-*Chlamydia* effects per se and/or to be immunologically compatible with the receiver (i.e., matched HLA haplotype). APCs may generally be isolated from any of a variety of biological fluids and organs, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, *Nature* 392:245-251, 1998) and have been shown to be effective as a physiological adjuvant for eliciting prophylactic or therapeutic immunity (see Timmerman and Levy, *Ann. Rev. Med.* 50:507-529, 1999). In general, dendritic cells may be identified based on their typical shape (stellate in situ, with marked cytoplasmic processes (dendrites) visible in vitro), their ability to take up, process and present antigens with high efficiency, and their ability to activate naïve T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., *Nature Med.* 4:594-600, 1998).

Dendritic cells and progenitors may be obtained from peripheral blood, bone marrow, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide encoding a Chlamydial protein (or portion or other variant thereof) such that the Chlamydial polypeptide, or an immunogenic portion thereof, is expressed on the cell surface. Such transfection may take place ex vivo, and a composition or vaccine comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., *Immunology and cell Biology* 75:456-460, 1997. Antigen loading of dendritic cells may be achieved by incubating dendritic cells or progenitor cells with the Chlamydial polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

Routes and frequency of administration of pharmaceutical compositions and vaccines, as well as dosage, will vary from individual to individual. In general, the pharmaceutical compositions and vaccines may be administered by injection (e.g., intracutaneous, intramuscular, intravenous or subcutaneous), intranasally (e.g., by aspiration) or orally. Between 1 and 3 doses may be administered for a 1-36 week period. Preferably, 3 doses are administered, at intervals of 3-4 months, and booster vaccinations may be given periodically thereafter. Alternate protocols may be appropriate for individual patients. A suitable dose is an amount of polypeptide or DNA that, when administered as described above, is capable of raising an immune response in an immunized patient sufficient to protect the patient from Chlamydial infection for at least 1-2 years. In general, the amount of polypeptide present in a dose (or produced in situ by the DNA in a dose) ranges from about 1 pg to about 100 mg per kg of host, typically from about 10 pg to about 1 mg, and preferably from about 100 pg to about 1 µg. Suitable dose sizes will vary with the size of the patient, but will typically range from about 0.1 mL to about 5 mL.

While any suitable carrier known to those of ordinary skill in the art may be employed in the pharmaceutical compositions of this invention, the type of carrier will vary depending on the mode of administration. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactic galactide) may also be employed as carriers for the pharmaceutical compositions of this invention. Suitable biodegradable microspheres are disclosed, for example, in U.S. Pat. Nos. 4,897,268 and 5,075,109.

In general, an appropriate dosage and treatment regimen provides the active compound(s) in an amount sufficient to provide therapeutic and/or prophylactic benefit. Such a response can be monitored by establishing an improved clinical outcome in treated patients as compared to non-treated patients. Increases in preexisting immune responses to a Chlamydial protein generally correlate with an improved clinical outcome. Such immune responses may generally be evaluated using standard proliferation, cytotoxicity or cytokine assays, which may be performed using samples obtained from a patient before and after treatment.

In another aspect, the present invention provides methods for using the polypeptides described above to diagnose Chlamydial infection. In this aspect, methods are provided for detecting Chlamydial infection in a biological sample, using one or more of the above polypeptides, either alone or in combination. For clarity, the term "polypeptide" will be used when describing specific embodiments of the inventive diagnostic methods. However, it will be clear to one of skill in the art that the fusion proteins of the present invention may also be employed in such methods.

As used herein, a "biological sample" is any antibody-containing sample obtained from a patient. Preferably, the sample is whole blood, sputum, serum, plasma, saliva, cerebrospinal fluid or urine. More preferably, the sample is a blood, serum or plasma sample obtained from a patient. The polypeptides are used in an assay, as described below, to determine the presence or absence of antibodies to the polypeptide(s) in the sample, relative to a predetermined cut-off value. The presence of such antibodies indicates previous sensitization to *Chlamydia* antigens which may be indicative of *Chlamydia*-infection.

In embodiments in which more than one polypeptide is employed, the polypeptides used are preferably complementary (i.e., one component polypeptide will tend to detect infection in samples where the infection would not be detected by another component polypeptide). Complementary polypeptides may generally be identified by using each polypeptide individually to evaluate serum samples obtained from a series of patients known to be infected with *Chlamydia*. After determining which samples test positive (as described below) with each polypeptide, combinations of two or more polypeptides may be formulated that are capable of detecting infection in most, or all, of the samples tested.

A variety of assay formats are known to those of ordinary skill in the art for using one or more polypeptides to detect antibodies in a sample. See, e.g., Harlow and Lane, *Antibodies: A Laboratory Manual*, Cold Spring Harbor Laboratory, 1988, which is incorporated herein by reference. In a preferred embodiment, the assay involves the use of polypeptide immobilized on a solid support to bind to and remove the antibody from the sample. The bound antibody may then be detected using a detection reagent that contains a reporter group. Suitable detection reagents include antibodies that bind to the antibody/polypeptide complex and free polypeptide labeled with a reporter group (e.g., in a semi-competitive assay). Alternatively, a competitive assay may be utilized, in which an antibody that binds to the polypeptide is labeled with a reporter group and allowed to bind to the immobilized antigen after incubation of the antigen with the sample. The extent to which components of the sample inhibit the binding of the labeled antibody to the polypeptide is indicative of the reactivity of the sample with the immobilized polypeptide.

The solid support may be any solid material known to those of ordinary skill in the art to which the antigen may be attached. For example, the solid support may be a test well in a microtiter plate, or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681.

The polypeptides may be bound to the solid support using a variety of techniques known to those of ordinary skill in the art. In the context of the present invention, the term "bound" refers to both noncovalent association, such as adsorption, and covalent attachment (which may be a direct linkage between the antigen and functional groups on the support or may be a linkage by way of a cross-linking agent). Binding by adsorption to a well in a microtiter plate or to a membrane is preferred. In such cases, adsorption may be achieved by contacting the polypeptide, in a suitable buffer, with the solid support for a suitable amount of time. The contact time varies with temperature, but is typically between about 1 hour and 1 day. In general, contacting a well of a plastic microtiter plate (such as polystyrene or polyvinylchloride) with an amount of polypeptide ranging from about 10 ng to about 1 µg, and preferably about 100 ng, is sufficient to bind an adequate amount of antigen.

Covalent attachment of polypeptide to a solid support may generally be achieved by first reacting the support with a bifunctional reagent that will react with both the support and a functional group, such as a hydroxyl or amino group, on the polypeptide. For example, the polypeptide may be bound to supports having an appropriate polymer coating using benzoquinone or by condensation of an aldehyde group on the support with an amine and an active hydrogen on the polypeptide (see, e.g., Pierce Immunotechnology Catalog and Handbook, 1991, at A12-A13).

In certain embodiments, the assay is an enzyme linked immunosorbent assay (ELISA). This assay may be performed by first contacting a polypeptide antigen that has been immobilized on a solid support, commonly the well of a microtiter plate, with the sample, such that antibodies to the polypeptide within the sample are allowed to bind to the immobilized polypeptide. Unbound sample is then removed from the immobilized polypeptide and a detection reagent capable of binding to the immobilized antibody-polypeptide complex is added. The amount of detection reagent that remains bound to the solid support is then determined using a method appropriate for the specific detection reagent.

More specifically, once the polypeptide is immobilized on the support as described above, the remaining protein binding sites on the support are typically blocked. Any suitable blocking agent known to those of ordinary skill in the art, such as bovine serum albumin (BSA) or Tween 20™ (Sigma Chemical Co., St. Louis, Mo.) may be employed. The immobilized polypeptide is then incubated with the sample, and antibody is allowed to bind to the antigen. The sample may be diluted with a suitable dilutent, such as phosphate-buffered saline (PBS) prior to incubation. In general, an appropriate contact time (i.e., incubation time) is that period of time that is sufficient to detect the presence of antibody within an HGE-infected sample. Preferably, the contact time is sufficient to achieve a level of binding that is at least 95% of that achieved at equilibrium between bound and unbound antibody. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. Detection reagent may then be added to the solid support. An appropriate detection reagent is any compound that binds to the immobilized antibody-polypeptide complex and that can be detected by any of a variety of means known to those in the art. Preferably, the detection reagent contains a binding agent (such as, for example, Protein A, Protein G, immunoglobulin, lectin or free antigen) conjugated to a reporter group. Preferred reporter groups include enzymes (such as horseradish peroxidase), substrates, cofactors, inhibitors, dyes, radionuclides, luminescent groups, fluorescent groups and biotin. The conjugation of binding agent to reporter group may be achieved using standard methods known to those of ordinary skill in the art. Common binding agents may also be purchased conjugated to a variety of reporter groups from many commercial sources (e.g., Zymed Laboratories, San Francisco, Calif., and Pierce, Rockford, Ill.).

The detection reagent is then incubated with the immobilized antibody-polypeptide complex for an amount of time sufficient to detect the bound antibody. An appropriate amount of time may generally be determined from the manufacturer's instructions or by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of anti-*Chlamydia* antibodies in the sample, the signal detected from the reporter group that remains bound to the solid support is generally compared to a signal that corresponds to a predetermined cut-off value. In one preferred embodiment, the cut-off value is the average mean signal obtained when the immobilized antigen is incubated with samples from an uninfected patient. In general, a sample generating a signal that is three standard deviations above the predetermined cut-off value is considered positive for *Chlamydia*-infection. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, pp. 106-107. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for Chlamydial infection.

In a related embodiment, the assay is performed in a rapid flow-through or strip test format, wherein the antigen is immobilized on a membrane, such as nitrocellulose. In the flow-through test, antibodies within the sample bind to the immobilized polypeptide as the sample passes through the membrane. A detection reagent (e.g., protein A-colloidal gold) then binds to the antibody-polypeptide complex as the solution containing the detection reagent flows through the membrane. The detection of bound detection reagent may then be performed as described above. In the strip test format, one end of the membrane to which polypeptide is bound is immersed in a solution containing the sample. The sample migrates along the membrane through a region containing detection reagent and to the area of immobilized polypeptide. Concentration of detection reagent at the polypeptide indicates the presence of anti-*Chlamydia* antibodies in the sample. Typically, the concentration of detection reagent at that site generates a pattern, such as a line, that can be read visually. The absence of such a pattern indicates a negative result. In general, the amount of polypeptide immobilized on the membrane is selected to generate a visually discernible pattern when the biological sample contains a level of antibodies that would be sufficient to generate a positive signal in an ELISA, as discussed above. Preferably, the amount of polypeptide immobilized on the membrane ranges from about 25 ng to about 1 µg, and more preferably from about 50 ng to about 500 ng. Such tests can typically be performed with a very small amount (e.g., one drop) of patient serum or blood.

Of course, numerous other assay protocols exist that are suitable for use with the polypeptides of the present invention. The above descriptions are intended to be exemplary only. One example of an alternative assay protocol which may be usefully employed in such methods is a Western blot, wherein the proteins present in a biological sample are separated on a gel, prior to exposure to a binding agent. Such techniques are well known to those of skill in the art.

The present invention further provides agents, such as antibodies and antigen-binding fragments thereof, that specifically bind to a Chlamydial protein. As used herein, an antibody, or antigen-binding fragment thereof, is said to "specifically bind" to a Chlamydial protein if it reacts at a detectable level (within, for example, an ELISA) with a Chlamydial protein, and does not react detectably with unrelated proteins under similar conditions. As used herein, "binding" refers to a noncovalent association between two separate molecules such that a complex is formed. The ability to bind may be evaluated by, for example, determining a binding constant for the formation of the complex. The binding constant is the value obtained when the concentration of the complex is divided by the product of the component concentrations. In general, two compounds are said to "bind," in the context of the present invention, when the binding constant for complex formation exceeds about $10^3$ L/mol. The binding constant may be determined using methods well known in the art.

Binding agents may be further capable of differentiating between patients with and without a Chlamydial infection using the representative assays provided herein. In other words, antibodies or other binding agents that bind to a Chlamydial protein will generate a signal indicating the presence of a Chlamydial infection in at least about 20% of patients with the disease, and will generate a negative signal indicating the absence of the disease in at least about 90% of individuals without infection. To determine whether a binding agent satisfies this requirement, biological samples (e.g., blood, sera, sputum urine and/or tissue biopsies) from patients with and without Chlamydial infection (as determined using standard clinical tests) may be assayed as described herein for the presence of polypeptides that bind to the binding agent. It will be apparent that a statistically significant number of samples with and without the disease should be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511-519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, *Antibodies: A Laboratory Manual*, Cold Spring Harbor Laboratory, 1988) and digested by papain to yield Fab and Fc fragments. The Fab and Fc fragments may be separated by affinity chromatography on protein A bead columns.

Monoclonal antibodies of the present invention may be coupled to one or more therapeutic agents. Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diphtheria toxin, cholera toxin, gelonin, *Pseudomonas* exotoxin, *Shigella* toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671, 958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers which provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562, to Davison et al. discloses representative chelating compounds and their synthesis.

A variety of routes of administration for the antibodies and immunoconjugates may be used. Typically, administration will be intravenous, intramuscular, subcutaneous or in site-specific regions by appropriate methods. It will be evident that the precise dose of the antibody/immunoconjugate will vary depending upon the antibody used, the antigen density, and the rate of clearance of the antibody.

Antibodies may be used in diagnostic tests to detect the presence of *Chlamydia* antigens using assays similar to those detailed above and other techniques well known to those of skill in the art, thereby providing a method for detecting Chlamydial infection in a patient.

Diagnostic reagents of the present invention may also comprise DNA sequences encoding one or more of the above polypeptides, or one or more portions thereof. For example, at least two oligonucleotide primers may be employed in a polymerase chain reaction (PCR) based assay to amplify *Chlamydia*-specific cDNA derived from a biological sample, wherein at least one of the oligonucleotide primers is specific for a DNA molecule encoding a polypeptide of the present invention. The presence of the amplified cDNA is then detected using techniques well known in the art, such as gel electrophoresis. Similarly, oligonucleotide probes specific for a DNA molecule encoding a polypeptide of the present invention may be used in a hybridization assay to detect the presence of an inventive polypeptide in a biological sample.

As used herein, the term "oligonucleotide primer/probe specific for a DNA molecule" means an oligonucleotide sequence that has at least about 80%, preferably at least about 90% and more preferably at least about 95%, identity to the DNA molecule in question. Oligonucleotide primers and/or probes which may be usefully employed in the inventive diagnostic methods preferably have at least about 10-40 nucleotides. In a preferred embodiment, the oligonucleotide primers comprise at least about 10 contiguous nucleotides of a DNA molecule encoding one of the polypeptides disclosed herein. Preferably, oligonucleotide probes for use in the inventive diagnostic methods comprise at least about 15 contiguous oligonucleotides of a DNA molecule encoding one of the polypeptides disclosed herein. Techniques for both PCR based assays and hybridization assays are well known in the art (see, for example, Mullis et al. Ibid; Ehrlich, Ibid). Primers or probes may thus be used to detect *Chlamydia*-specific sequences in biological samples. DNA probes or primers comprising oligonucleotide sequences described above may be used alone or in combination with each other.

The following Examples are offered by way of illustration and not by way of limitation.

Example 1

Isolation of DNA Sequences Encoding *Chlamydia* Antigens

*Chlamydia* antigens of the present invention were isolated by expression cloning of a genomic DNA library of *Chlamydia trachomatis* LGV II essentially as described by Sanderson et al. (*J. Exp. Med.*, 1995, 182:1751-1757) and were shown to induce PBMC proliferation and IFN-γ in an immunoreactive T cell line.

A *Chlamydia*-specific T cell line was generated by stimulating PBMCs from a normal donor with no history of chlamydial genital tract infection with elementary bodies of *Chlamydia trachomatis* LGV II. This T cell line, referred to as TCL-8, was found to recognize both *Chlamydia trachomatis* and *Chlamydia pneumonia* infected monocyte-derived dendritic cells.

A randomly sheared genomic library of *Chlamydia trachomatis* LGV II was constructed in Lambda ZAP (Stratagene, La Jolla, Calif.) and the amplified library plated out in 96 well microtiter plates at a density of 30 clones/well. Bacteria were induced to express recombinant protein in the presence of 2 mM IPTG for 3 h, then pelleted and resuspended in 200 µl of RPMI 10% FBS. 10 µl of the induced bacterial suspension was transferred to 96 well plates containing autologous monocyte-derived dendritic cells. After a 2 h incubation, dendritic cells were washed to remove free *E. coli* and *Chlamydia*-specific T cells were added. Positive *E. coli* pools were identified by determining IFN-γ production and proliferation of the T cells in response to the pools.

Four positive pools were identified, which were broken down to yield four pure clones (referred to as 1-B1-66, 4-D7-28, 3-G3-10 and 10-C10-31), with insert sizes of 481 bp, 183 bp, 110 bp and 1400 bp, respectively. The determined DNA sequences for 1-B1-66, 4-D7-28, 3-G3-10 and 10-C10-31 are provided in SEQ ID NO: 1-4, respectively. Clone 1-B1-66 is approximately in region 536690 of the *C. trachomatis* genome (NCBI *C. trachomatis* database). Within clone 1-B1-66, an open reading frame (ORF) has been identified (nucleotides 115-375) that encodes a previously identified 9 kDa protein (Stephens, et al. Genbank Accession No. AE001320), the sequence of which is provided in SEQ ID NO: 5). Clone 4-D7-28 is a smaller region of the same ORF (amino acids 22-82 of 1-B1-66). Clone 3-G3-10 is approximately in region 74559 of the *C. trachomatis* genome. The insert is cloned in the antisense orientation with respect to its orientation in the genome. The clone 10-C10-31 contains an open reading frame that corresponds to a previously published sequence for S13 ribosomal protein from *Chlamydia trachomatis* (Gu, L. et al. *J. Bacteriology*, 177:2594-2601, 1995). The predicted protein sequences for 4-D7-28 and 10-C10-31 are provided in SEQ ID NO: 6 and 12, respectively. Predicted protein sequences for 3-G3-10 are provided in SEQ ID NO: 7-11.

In a related series of screening studies, an additional T cell line was used to screen the genomic DNA library of *Chlamydia trachomatis* LGV II described above. A *Chlamydia*-specific T cell line (TCT-1) was derived from a patient with a chlamydial genital tract infection by stimulating patient PBMC with autologous monocyte-derived dendritic cells infected with elementary bodies of *Chlamydia trachomatis* LGV II. One clone, 4C9-18 (SEQ ID NO: 21), containing a 1256 bp insert, elicited a specific immune response, as measured by standard proliferation assays, from the *Chlamydia*-specific T cell line TCT-1. Subsequent analysis revealed this clone to contain three known sequences: lipoamide dehydrogenase (Genbank Accession No. AE001326), disclosed in SEQ ID NO: 22; a hypothetical protein CT429 (Genbank Accession No. AE001316), disclosed in SEQ ID NO: 23; and part of an open reading frame of ubiquinone methyltransferase CT428 (Genbank Accession No. AE001316), disclosed in SEQ ID NO: 24.

In further studies involving clone 4C9-18 (SEQ ID NO: 21), the full-length amino acid sequence for lipoamide dehydrogenase (SEQ ID NO: 22) from *C. trachomatis* (LGV II) was expressed in clone CtL2-LPDA-FL, as disclosed in SEQ ID NO: 90.

To further characterize the open reading frame containing the T cell stimulating epitope(s), a cDNA fragment containing nucleotides 1-695 of clone 4C9-18 with a cDNA sequence encoding a 6x-Histidine tag on the amino terminus was subcloned into the NdeI/EcoRI site of the pET17b vector (Novagen, Madison, Wis.), referred to as clone 4C9-18#2 BL21 pLysS (SEQ ID NO: 25, with the corresponding amino acid sequence provided in SEQ ID NO: 26) and transformed into *E. coli*. Selective induction of the transformed *E. coli* with 2 mM IPTG for three hours resulted in the expression of a 26 kDa protein from clone 4C9-18#2 BL21 pLysS, as evidenced by standard Coomassie-stained SDS-PAGE. To determine the immunogenicity of the protein encoded by clone 4C9-18#2 BL21 pLysS, *E. coli* expressing the 26 kDa protein were titered onto 1×10$^4$ monocyte-derived dendritic cells and incubated for two hours. The dendritic cell cultures were washed and 2.5×10$^4$ T cells (TCT-1) added and allowed to incubate for an additional 72 hours, at which time the level of IFN-γ in the culture supernatant was determined by ELISA. As shown in FIG. 1, the T-cell line TCT-1 was found to respond to induced cultures as measured by IFN-g, indicating a *Chlamydia*-specific T-cell response against the lipoamide dehydrogenase sequence. Similarly, the protein encoded by clone 4C9-18#2 BL21 pLysS was shown to stimulate the TCT-1 T-cell line by standard proliferation assays.

Subsequent studies to identify additional *Chlamydia trachomatis* antigens using the above-described CD4+ T-cell expression cloning technique yielded additional clones. The TCT-1 and TCL-8 *Chlamydia*-specific T-cell lines, as well as the TCP-21 T-cell line were utilized to screen the *Chlamydia trachomatis* LGVII genomic library. The TCP-21 T-cell line was derived from a patient having a humoral immune response to *Chlamydia pnuemoniae*. The TCT-1 cell line identified 37 positive pools, the TCT-3 cell line identified 41 positive pools and the TCP-21 cell line identified 2 positive pools. The following clones were derived from 10 of these positive pools. Clone 1-A3-93 (SEQ ID NO: 64), identified by the TCP-21 cell line, is a 1339 bp genomic fragment sharing homology to the HAD superfamily (CT103). The second insert in the same clone shares homology with the fab I gene (CT104) present on the complementary strand. Clone 11-C12-91 (SEQ ID NO: 63), identified using the TCP-21 cell line, has a 269 bp insert that is part of the OMP2 gene (CT443) and shares homology with the 60 kDa cysteine rich outer membrane protein of *C. pnuemoniae*.

Clone 11-G10-46, (SEQ ID NO: 62), identified using the TCT-3 cell line, contains a 688 bp insert that shares homology to the hypothetical protein CT610. Clone 11-G1-34, (SEQ ID NO: 61), identified using the TCT-3 cell line, has two partial open reading frames (ORF) with an insert size of 1215 bp. One ORF shares homology to the malate dehydrogenase gene (CT376), and the other ORF shares homology to the glycogen hydrolase gene (CT042). Clone 11-H3-68, (SEQ ID NO: 60), identified using the TCT-3 cell line, has two ORFs with a total insert size of 1180 bp. One partial ORF encodes the plasmid-encoded PGP6-D virulence protein while the second ORF is a complete ORF for the L1 ribosomal gene (CT318). Clone 11-H4-28, (SEQ ID NO: 59), identified using the TCT-3 cell line, has an insert size of 552 bp and is part of the ORF for the dnaK gene (CT396). Clone 12-B3-95, (SEQ ID NO: 58), identified using the TCT-1 cell line, has an insert size of 463 bp and is a part of the ORF for the lipoamide dehydrogenase gene (CT557). Clones 15-G1-89 and 12-B3-95 are identical, (SEQ ID NO: 55 and 58, respectively), identified using the TCT-1 cell line, has an insert size of 463 bp and is part of the ORF for the lipoamide dehydrogenase gene (CT557). Clone 12-G3-83, (SEQ ID NO: 57), identified using the TCT-1 cell line, has an insert size of 1537 bp and has part of the ORF for the hypothetical protein CT622.

Clone 23-G7-68, (SEQ ID NO: 79), identified using the TCT-3 cell line, contains a 950 bp insert and contains a small part of the L11 ribosomal ORF, the entire ORF for L1 ribosomal protein and a part of the ORF for L10 ribosomal protein. In addition, this clone also identified the patient lines CT4, CT5, CT11, CT12, and CHH037. Clone 22-F8-91, (SEQ ID NO: 80), identified using the TCT-1 cell line, contains a 395 bp insert that contains a part of the pmpC ORF on the complementary strand of the clone. Clone 21-E8-95, (SEQ ID NO: 81), identified using the TCT-3 cell line, contains a 2,085 bp insert which contains part of CT613 ORF, the complete ORF for CT612, the complete ORF for CT611 and part of the ORF for CT610. Clone 19-F12-57, (SEQ ID NO: 82), identified using the TCT-3 cell line, contains a 405 bp insert which contains part of the CT 858 ORF and a small part of the recA ORF. Clone 19-F12-53, (SEQ ID NO: 83), identified using the TCT-3 cell line, contains a 379 bp insert that is part of the ORF for CT455 encoding glutamyl tRNA synthetase. Clone 19-A5-54, (SEQ ID NO: 84), identified using the TCT-3 cell line, contains a 715 bp insert that is part of the ORF3 (complementary strand of the clone) of the cryptic plasmid. Clone 17-E11-72, (SEQ ID NO: 85), identified using the TCT-1 cell line, contains a 476 bp insert that is part of the ORF for Opp_2 and pmpD. The pmpD region of this clone is covered by the pmpD region of clone 15-H2-76. Clone 17-C1-77, (SEQ ID NO: 86), identified using the patient cell lines CT3, CT1, CT4, and CT12, contains a 1551 bp insert that is part of the CT857 ORF, as well as part of the CT858 ORF. Clone 15-H2-76, (SEQ ID NO: 87), identified using the TCT-1 cell line, contains a 3,031 bp insert that contains a large part of the pmpD ORF, part of the CT089 ORF, as well as part of the ORF for SycE. Clone 15-A3-26, (SEQ ID NO: 88), contains a 976 bp insert that contains part of the ORF for CT858. Clone 17-G4-36, (SEQ ID NO: 267), identified using the patient lines CL8, TCT-10, CT1, CT5, CT13, and CHH037, contains a 680 bp insert that is in frame with beta-gal in the plasmid and shares homology to part of the ORF for DNA-directed RNA polymerase beta subunit (CT315 in SerD).

Several of the clones described above share homology to various polymorphic membrane proteins. The genomic sequence of Chlamydia trachomatis contains a family of nine polymorphic membrane protein genes, referred to as pmp. These genes are designated pmpA, pmpB, pmpC, pmpD, pmpE, pmpF, pmpG, pmpH and pmpI. Proteins expressed from these genes are believed to be of biological relevance in generating a protective immune response to a Chlamydial infection. In particular, pmpC, pmpD, pmpE and pmpI contain predictable signal peptides, suggesting they are outer membrane proteins, and therefore, potential immunological targets.

Based on the *Chlamydia trachomatis* LGVII serovar sequence, primer pairs were designed to PCR amplify the full-length fragments of pmpC, pmpD, pmpE, pmpG, pmpH and pmpI. The resulting fragments were subcloned into the DNA vaccine vector JA4304 or JAL, which is JA4304 with a modified linker (SmithKline Beecham, London, England). Specifically, PmpC was subcloned into the JAL vector using the 5' oligo GAT AGG CGC GCC GCA ATC ATG AAA TTT ATG TCA GCT ACT GCT G and the 3' oligo CAG AAC GCG TTT AGA ATG TCA TAC GAG CAC CGC A, as provided in SEQ ID NO: 197 and 198, respectively. PCR amplification of the gene under conditions well known in the art and ligation into the 5' ASCI/3' MluI sites of the JAL vector was completed after inserting the short nucleotide sequence GCAATC (SEQ ID NO: 199) upstream of the ATG to create a Kozak-like sequence. The resulting expression vector contained the full-length pmpC gene comprising 5325 nucleotides (SEQ ID NO: 173) containing the hypothetical signal sequence, which encodes a 187 kD protein (SEQ ID NO: 179). The pmpD gene was subcloned into the JA4304 vaccine vector following PCR amplification of the gene using the following oligos: 5' oligo-TGC AAT CAT GAG TTC GCA GAA AGA TAT AAA AAG C (SEQ ID NO: 200) and 3' oligo-CAG AGC TAG CTT AAA AGA TCA ATC GCA ATC CAG TAT TC (SEQ ID NO: 201). The gene was ligated into the a 5' blunted HIII/3' MluI site of the JA4304 vaccine vector using standard techniques well known in the art. The CAATC (SEQ ID NO: 202) was inserted upstream of the ATG to create a Kozak-like sequence. This clone is unique in that the last threonine of the HindIII site is missing due to the blunting procedure, as is the last glycine of the Kozak-like sequence. The insert, a 4593 nucleotide fragment (SEQ ID NO: 172) is the full-length gene for pmpD containing the hypothetical signal sequence, which encodes a 161 kD protein (SEQ ID NO: 178). PmpE was subcloned into the JA4304 vector using the 5' oligo-TGC AAT CAT GAA AAA AGC GTT TTT CTT TTT C (SEQ ID NO: 203), and the 3' oligo-CAG AAC GCG TCT AGA ATC GCA GAG CAA TTT C (SEQ ID NO: 204). Following PCR amplification, the gene was ligated into the 5' blunted HIII/3' MluI site of JA4304. To facilitate this, a short nucleotide sequence, TGCAATC (SEQ ID NO: 293), was added upstream of the initiation codon for creating a Kozak-like sequence and reconstituting the HindIII site. The insert is the full-length pmpE gene (SEQ ID NO: 171) containing the hypothetical signal sequence. The pmpE gene encodes a 105 kD protein (SEQ ID NO: 177). The pmpG gene was PCR amplified using the 5' oligo-GTG CAA TCA TGA TTC CTC AAG GAA TTT ACG (SEQ ID NO: 205), and the 3' oligo-CAG AAC GCG TTT AGA ACC GGA CTT TAC TTC C (SEQ ID NO: 206) and subcloned into the JA4304 vector. Similar cloning strategies were followed for the pmpI and pmpK genes. In addition, primer pairs were designed to PCR amplify the full-length or overlapping fragments of the pmp genes, which were then subcloned for protein expression in the pET17b vector (Novagen, Madison, Wis.) and transfected into *E. coli* BL21 pLysS for expression and subsequent purification utilizing the histidine-nickel chromatographic methodology provided by Novagen. Several of the genes encoding the recombinant proteins, as described below, lack the native signal sequence to facilitate expression of the protein. Full-length protein expression of pmpC was accomplished through expression of two overlapping fragments, representing the amino and carboxy termini. Subcloning of the pmpC-amino terminal portion, which lacks the signal sequence, (SEQ ID NO: 187, with the corresponding amino acid sequence provided in SEQ ID NO: 195) used the 5' oligo-CAG ACA TAT GCA TCA CCA TCA CCA TCA CGA GGC GAG CTC GAT CCA AGA TC (SEQ ID NO: 207), and the 3' oligo-CAG AGG TAC CTC AGA TAG CAC TCT CTC CTA TTA AAG TAG G (SEQ ID NO: 208) into the 5' NdeI/3' KPN cloning site of the vector. The carboxy terminus portion of the gene, pmpC-carboxy terminal fragment (SEQ ID NO: 186, with the corresponding amino acid sequence provided in SEQ ID NO: 194), was subcloned into the 5' NheI/3' KPN cloning site of the expression vector using the following primers: 5' oligo-CAG AGC TAG CAT GCA TCA CCA TCA CCA TCA CGT TAA GAT TGA GAA CTT CTC TGG C (SEQ ID NO: 209), and 3' oligo-CAG AGG TAC CTT AGA ATG TCA TAC GAG CAC CGC AG (SEQ ID NO: 210). PmpD was also expressed as two overlapping proteins. The pmpD-amino terminal portion, which lacks the signal sequence, (SEQ ID NO: 185, with the corresponding amino acid sequence provided in SEQ ID NO: 193) contains the initiating codon of the pET17b and is expressed as a 80 kD protein. For protein expression and purification purposes, a six-histidine tag follows the initiation codon and is fused at the $28^{th}$ amino acid (nucleotide 84) of the gene. The following primers were used, 5' oligo, CAG ACA TAT GCA TCA CCA TCA CCA TCA CGG GTT AGC (SEQ ID NO: 211), and the 3' oligo-CAG AGG TAC CTC AGC TCC TCC AGC ACA CTC TCT TC (SEQ ID NO: 212), to splice into the 5' NdeI/3' KPN cloning site of the vector. The pmpD-carboxy terminus portion (SEQ ID NO: 184) was expressed as a 92 kD protein (SEQ ID NO: 192). For expression and subsequent purification, an additional methionine, alanine and serine was included, which represent the initiation codon and the first two amino acids from the pET17b vector. A six-histidine tag downstream of the methionine, alanine and serine is fused at the $691^{st}$ amino acid (nucleotide 2073) of the gene. The 5' oligo-CAG AGC TAG CCA TCA CCA TCA CCA TCA CGG TGC TAT TTC TTG CTT ACG TGG (SEQ ID NO: 213) and the 3' oligo-CAG AGG TAC TTn AAA AGA TCA ATC GCA ATC CAG TAT TCG (SEQ ID NO: 214) were used to subclone the insert into the 5' NheI/3' KPN cloning site of the expression vector. PmpE was expressed as a 106 kD protein (SEQ ID NO: 183 with the corresponding amino acid sequence provided in SEQ ID NO: 191). The pmpE insert also lacks the native signal sequence. PCR amplification of the gene under conditions well known in the art was performed using the following oligo primers: 5' oligo-CAG AGG ATC CAC ATC ACC ATC ACC ATC ACG GAC TAG CTA GAG AGG TTC (SEQ ID NO: 215), and the 3' oligo-CAG AGA ATT CCT AGA ATC GCA GAG CAA TTT C (SEQ ID NO: 216), and the amplified insert was ligated into a 5' BamHI/3' EcoRI site of JA4304. The short nucleotide sequence, as provided in SEQ ID NO: 217, was inserted upstream of the initiation codon for creating the Kozak-like sequence and reconstituting the HindIII site. The expressed protein contains the initiation codon and the downstream 21 amino acids from the pET17b expression vector, i.e., MASMTGGQQMGRDSSLVPSSDP (SEQ ID NO: 218). In addition, a six-histidine tag is included upstream of the sequence described above and is fused at the $28^{th}$ amino acid (nucleotide 84) of the gene, which eliminates the hypothetical signal peptide. The sequences provided in SEQ ID NO: 183 with the corresponding amino acid sequence provided in SEQ ID NO: 191 do not include these additional sequences. The pmpG gene (SEQ ID NO: 182, with the corresponding amino acid sequence provided in SEQ ID No; 190) was PCR amplified under conditions well known in the art using the following oligo primers: 5' oligo-CAG AGG TAC CGC ATC ACC ATC ACC ATC ACA TGA TTC CTC AAG GAA TTT ACG (SEQ ID NO: 219), and the 3' oligo- CAG AGC GGC CGC TTA GAA CCG GAC TTT ACT TCC (SEQ ID NO: 220), and ligated into the 5' KPN/3' NotI cloning site of the expression vector. The expressed protein contains an additional amino acid sequence at the amino end, namely, MASMTGGQQNGRDSSLVPHHHHHH (SEQ ID NO: 221), which comprises the initiation codon and additional sequence from the pET17b expression vector. The pmpI gene (SEQ ID NO: 181, with the corresponding amino acid sequence provided in SEQ ID No; 189) was PCR amplified under conditions well known in the art using the following oligo primers: 5' oligo-CAG AGC TAG CCA TCA CCA TCA CCA TCA CCT CTT TGG CCA GGA TCC C (SEQ ID NO: 222), and the 3' oligo-CAG AAC TAG TCT AGA ACC TGT AAG TGG TCC (SEQ ID NO: 223), and ligated into the expression vector at the 5' NheI/3' SpeI cloning site. The 95 kD expressed protein contains the initiation codon plus an additional alanine and serine from the pET17b vector at the amino end of the protein. In addition, a six-histidine tag is fused at the $21^{st}$ amino acid of the gene, which eliminates the hypothetical signal peptide.

Clone 14-H1-4, (SEQ ID NO: 56), identified using the TCT-3 cell line, contains a complete ORF for the TSA gene, thiol specific antioxidant—CT603 (the CT603 ORF is a homolog of CPn0778 from *C. pnuemoniae*). The TSA open reading frame in clone 14-H1-4 was amplified such that the expressed protein possess an additional methionine and a 6× histidine tag (amino terminal end). This amplified insert was sub-cloned into the Nde/EcoRI sites of the pET17b vector. Upon induction of this clone with IPTG, a 22.6 kDa protein was purified by Ni-NTA agarose affinity chromatography. The determined amino acid sequence for the 195 amino acid ORF of clone 14-H1-4 encoding the TSA gene is provided in SEQ ID NO: 65. Further analysis yielded a full-length clone for the TSA gene, referred to as CTL2-TSA-FL, with the full-length amino acid sequence provided in SEQ ID NO: 92.

Further studies yielded 10 additional clones identified by the TCT-1 and TCT-3 T-cell lines, as described above. The clones identified by the TCT-1 line are: 16-D4-22, 17-C5-19, 18-C5-2, 20-G3-45 and 21-C7-66; clones identified by the TCT-3 cell line are: 17-C10-31, 17-E2-9, 22-A1-49 and 22-B3-53. Clone 21-G12-60 was recognized by both the TCT-1 and TCT-3 T cell lines. In addition, clone 20-G3-45, which contained sequence specific for pmpB, was identified against the patient lines CT1 and CT4. Clone 16-D4-22 (SEQ ID NO: 119), identified using the TCT-1 cell line contains a 953 bp insert that contains two genes, parts of open reading frame 3 (ORF3) and ORF4 of the *C. trachomatis* plasmid for growth within mammalian cells. Clone 17-C5-19 (SEQ ID NO: 118), contains a 951 bp insert that contains part of the ORF for DT431, encoding for clpP_1 protease and part of the ORF for CT430 (diaminopimelate epimerase). Clone 18-C5-2 (SEQ ID NO: 117) is part of the ORF for S1 ribosomal protein with a 446 bp insert that was identified using the TCT-1 cell line. Clone 20-G3-45 (SEQ ID NO: 116), identified by the TCT-1 cell line, contains a 437 bp insert that is part of the pmpB gene (CT413). Clone 21-C7-8 (SEQ ID NO: 115), identified by the TCT-1 line, contains a 995 bp insert that encodes part of the dnaK like protein. The insert of this clone does not overlap with the insert of the TCT-3 clone 11-H4-28 (SEQ ID NO: 59), which was shown to be part of the dnaK gene CT396. Clone 17-C10-31 (SEQ ID NO: 114), identified by the TCT-3 cell line, contains a 976 bp insert. This clone contains part of the ORF for CT858, a protease containing IRBP and DHR domains. Clone 17-E2-9 (SEQ ID NO: 113) contains part of ORFs for two genes, CT611 and CT610, that span a 1142 bp insert. Clone 22-A1-49 (SEQ ID NO: 112), identified using the TCT-3 line, also contains two genes in a 698 bp insert. Part of the ORF for CT660 (DNA gyrase {gyrA_2}) is present on the top strand where as the complete ORF for a hypothetical protein CT659 is present on the complementary strand. Clone 22-B3-53 (SEQ ID NO: 111), identified by the TCT-1 line, has a 267 bp insert that encodes part of the ORF for GroEL (CT110). Clone 21-G12-60 (SEQ ID NO: 110), identified by both the TCT-1 and TCT-3 cell lines contains a 1461 bp insert that contains partial ORFs for hypothetical proteins CT875, CT229 and CT228.

Additional Chlamydia antigens were obtained by screening a genomic expression library of Chlamydia trachomatis (LGV II serovar) in Lambda Screen-1 vector (Novagen, Madison, Wis.) with sera pooled from several Chlamydia-infected individuals using techniques well known in the art. The following immuno-reactive clones were identified and the inserts containing *Chlamydia* genes sequenced: CTL2#1 (SEQ ID NO: 71); CTL2#2 (SEQ ID NO: 70); CTL2#3-5' (SEQ ID NO: 72, a first determined genomic sequence representing the 5' end); CTL2#3-3' (SEQ ID NO: 73, a second determined genomic sequence representing the 3' end); CTL2#4 (SEQ ID NO: 53); CTL2#5 (SEQ ID NO: 69); CTL2#6 (SEQ ID NO: 68); CTL2#7 (SEQ ID NO: 67); CTL2#8b (SEQ ID NO: 54); CTL2#9 (SEQ ID NO: 66); CTL2#10-5' (SEQ ID NO: 74, a first determined genomic sequence representing the 5' end); CTL2#10-3' (SEQ ID NO: 75, a second determined genomic sequence representing the 3' end); CTL2#11-5' (SEQ ID NO: 45, a first determined genomic sequence representing the 5' end); CTL2#11-3' (SEQ ID NO: 44, a second determined genomic sequence representing the 3' end); CTL2#12 (SEQ ID NO: 46); CTL2#16-5' (SEQ ID NO: 47); CTL2#18-5' (SEQ ID NO: 49, a first determined genomic sequence representing the 5' end); CTL2#18-3' (SEQ ID NO: 48, a second determined genomic sequence representing the 3' end); CTL2#19-5' (SEQ ID NO: 76, the determined genomic sequence representing the 5' end); CTL2#21 (SEQ ID NO: 50); CTL2#23 (SEQ ID NO: 51; and CTL2#24 (SEQ ID NO: 52).

Additional *Chlamydia trachomatis* antigens were identified by serological expression cloning. These studies used sera pooled from several *Chlamydia*-infected individuals, as described above, but, IgA, and IgM antibodies were used in addition to IgG as a secondary antibody. Clones screened by this method enhance detection of antigens recognized by an early immune response to a Chlamydial infection, that is a mucosal humoral immune response. The following immunoreactive clones were characterized and the inserts containing *Chlamydia* genes sequenced: CTL2gam-1 (SEQ ID NO: 290), CTL2gam-2 (SEQ ID NO: 289), CTL2gam-5 (SEQ ID NO: 288), CTL2gam-6-3' (SEQ ID NO: 287, a second determined genomic sequence representing the 3' end), CTL2gam-6-5' (SEQ ID NO: 286, a first determined genomic sequence representing the 5' end), CTL2gam-8 (SEQ ID NO: 285), CTL2gam-10 (SEQ ID NO: 284), CTL2gam-13 (SEQ ID NO: 283), CTL2gam-15-3' (SEQ ID NO: 282, a second determined genomic sequence representing the 3' end), CTL2gam-15-5' (SEQ ID NO: 281, a first determined genomic sequence representing the 5' end), CTL2gam-17 (SEQ ID NO: 280), CTL2gam-18 (SEQ ID NO: 279), CTL2gam-21 (SEQ ID NO: 278), CTL2gam-23 (SEQ ID NO: 277), CTL2gam-24 (SEQ ID NO: 276), CTL2gam-26 (SEQ ID NO: 275), CTL2gam-27 (SEQ ID NO: 274), CTL2gam-28 (SEQ ID NO: 273), CTL2gam-30-3' (SEQ ID NO: 272, a second determined genomic sequence representing the 3' end) and CTL2gam-30-5' (SEQ ID NO: 271, a first determined genomic sequence representing the 5' end).

Example 2

Induction of T Cell Proliferation and Interferon-γProduction by *Chlamydia Trachomatis* Antigens The ability of recombinant *Chlamydia trachomatis* antigens to induce T cell proliferation and interferon-γ production is determined as follows.

Proteins are induced by IPTG and purified by Ni-NTA agarose affinity chromatograph (Webb et al., *J. Immunology* 157:5034-5041, 1996). The purified polypeptides are then screened for the ability to induce T-cell proliferation in PBMC preparations. PBMCs from *C. trachomatis* patients as well as from normal donors whose T-cells are known to proliferate in response to *Chlamydia* antigens, are cultured in medium comprising RPMI 1640 supplemented with 10% pooled human serum and 50 μg/ml gentamicin. Purified polypeptides are added in duplicate at concentrations of 0.5 to 10 μg/mL. After six days of culture in 96-well round-bottom plates in a volume of 200 μl, 50 μl of medium is removed from each well for determination of IFN-γ levels, as described below. The plates are then pulsed with 1 μCi/well of tritiated thymidine for a further 18 hours, harvested and tritium uptake determined using a gas scintillation counter. Fractions that result in proliferation in both replicates three fold greater than the proliferation observed in cells cultured in medium alone are considered positive.

IFN-γ is measured using an enzyme-linked immunosorbent assay (ELISA). ELISA plates are coated with a mouse monoclonal antibody directed to human IFN-γ (PharMingen, San Diego, Calif.) in PBS for four hours at room temperature. Wells are then blocked with PBS containing 5% (W/V) non-fat dried milk for 1 hour at room temperature. The plates are washed six times in PBS/0.2% TWEEN-20 and samples diluted 1:2 in culture medium in the ELISA plates are incubated overnight at room temperature. The plates are again washed and a polyclonal rabbit anti-human IFN-γ serum diluted 1:3000 in PBS/10% normal goat serum is added to each well. The plates are then incubated for two hours at room temperature, washed and horseradish peroxidase-coupled anti-rabbit IgG (Sigma Chemical So., St. Louis, Mo.) is added at a 1:2000 dilution in PBS/5% non-fat dried milk. After a further two hour incubation at room temperature, the plates are washed and TMB substrate added. The reaction is stopped after 20 min with 1 N sulfuric acid. Optical density is determined at 450 nm using 570 nm as a reference wavelength. Fractions that result in both replicates giving an OD two fold greater than the mean OD from cells cultured in medium alone, plus 3 standard deviations, are considered positive.

Using the above methodology, recombinant 1B1-66 protein (SEQ ID NO: 5) as well as two synthetic peptides corresponding to amino acid residues 48-67 (SEQ ID NO: 13; referred to as 1-B1-66/48-67) and 58-77 (SEQ ID NO: 14, referred to as 1B1-66/58-77), respectively, of SEQ ID NO: 5, were found to induce a proliferative response and IFN-γ production in a *Chlamydia*-specific T cell line used to screen a genomic library of *C. trachomatis* LGV II.

Further studies have identified a *C. trachomatis*-specific T-cell epitope in the ribosomal S13 protein. Employing standard epitope mapping techniques well known in the art, two T-cell epitopes in the ribosomal S13 protein (rS13) were identified with a *Chlamydia*-specific T-cell line from donor CL-8 (T-cell line TCL-8 EB/DC). FIG. 8 illustrates that the first peptide, rS13 1-20 (SEQ ID NO: 106), is 100% identical with the corresponding *C. pneumoniae* sequence, explaining the cross-reactivity of the T-cell line to recombinant *C. tra-*

*chomatis*- and *C. pneumoniae*-rS13. The response to the second peptide rS13 56-75 (SEQ ID NO: 108) is *C. trachomatis*-specific, indicating that the rS13 response in this healthy asymptomatic donor was elicited by exposure to *C. trachomatis* and not to *C. pneumoniae*, or any other microbial infection.

As described in Example 1, Clone 11-C12-91 (SEQ ID NO: 63), identified using the TCP-21 cell line, has a 269 bp insert that is part of the OMP2 gene (CT443) and shares homology with the 60 kDa cysteine rich outer membrane protein of *C. pneumoniae*, referred to as OMCB. To further define the reactive epitope(s), epitope mapping was performed using a series of overlapping peptides and the immunoassay previously described. Briefly, proliferative responses were determined by stimulating $2.5 \times 10^4$ TCP-21 T-cells in the presence of $1 \times 10^4$ monocyte-derived dendritic cells with either non-infectious elementary bodies derived from *C. trachomatis* and *C. pneumoniae*, or peptides derived from the protein sequence of *C. trachomatis* or *C. pneumoniae* OMCB protein (0.1 µg/ml). The TCP-21 T-cells responded to epitopes CT-OMCB #167-186, CT-OMCB #171-190, CT-OMCB #171-186, and to a lesser extent, CT-OMCB #175-186 (SEQ ID NO: 249-252, respectively). Notably, the TCP-21 T-cell line also gave a proliferative response to the homologous *C. pneumoniae* peptide CP-OMCB #171-186 (SEQ ID NO: 253), which was equal to or greater than the response to the *C. trachomatis* peptides. The amino acid substitutions in position two (i.e., Asp for Glu) and position four (i.e., Cys for Ser) did not alter the proliferative response of the T-cells and therefore demonstrating this epitope to be a cross-reactive epitope between *C. trachomatis* and *C. pneumoniae*.

To further define the epitope described above, an additional T-cell line, TCT-3, was used in epitope mapping experiments. The immunoassays were performed as described above, except that only peptides from *C. trachomatis* were tested. The T-cells gave a proliferative response to two peptides, CT-OMCB #152-171 and CT-OMCB #157-176 (SEQ ID NO: 246 and 247, respectively), thereby defining an additional immunogenic epitope in the cysteine rich outer membrane protein of *C. trachomatis*.

Clone 14H1-4, (SEQ ID NO: 56, with the corresponding full-length amino acid sequence provided in SEQ ID NO: 92), was identified using the TCT-3 cell line in the CD4 T-cell expression cloning system previously described, and was shown to contain a complete ORF for the, thiol specific antioxidant gene (CT603), referred to as TSA. Epitope mapping immunoassays were performed, as described above, to further define the epitope. The TCT-3 T-cells line exhibited a strong proliferative response to the overlapping peptides CT-TSA #96-115, CT-TSA #101-120 and CT-TSA #106-125 (SEQ ID NO: 254-256, respectively) demonstrating an immunoreactive epitope in the thiol specific antioxidant gene of *C. trachomatis* serovar LGVII.

Example 3

Preparation of Synthetic Polypeptides

Polypeptides may be synthesized on a Millipore 9050 peptide synthesizer using FMOC chemistry with HPTU (O-Benzotriazole-N,N,N',N'-tetramethyluronium hexafluorophosphate) activation. A Gly-Cys-Gly sequence may be attached to the amino terminus of the peptide to provide a method of conjugating or labeling of the peptide. Cleavage of the peptides from the solid support may be carried out using the following cleavage mixture: trifluoroacetic acid: ethanedithiol:thioanisole:water:phenol (40:1:2:2:3). After cleaving for 2 hours, the peptides may be precipitated in cold methyl-t-butyl-ether. The peptide pellets may then be dissolved in water containing 0.1% trifluoroacetic acid (TFA) and lyophilized prior to purification by C18 reverse phase HPLC. A gradient of 0-60% acetonitrile (containing 0.1% TFA) in water (containing 0.1% TFA) may be used to elute the peptides. Following lyophilization of the pure fractions, the peptides may be characterized using electrospray mass spectrometry and by amino acid analysis.

Example 4

Isolation and Characterization of DNA Sequences Encoding *Chlamydia* Antigens Using Retroviral Expression Vector Systems and Subsequent Immunological Analysis A genomic library of *Chlamydia trachomatis* LGV II was constructed by limited digests using BamHI, BglII, BstYi and MboI restriction enzymes. The restriction digest fragments were subsequently ligated into the BamHI site of the retroviral vectors pBIB-KS1,2,3. This vector set was modified to contain a Kosak translation initiation site and stop codons in order to allow expression of proteins from short DNA genomic fragments, as shown in FIG. 2. DNA pools of 80 clones were prepared and transfected into the retroviral packaging line Phoenix-Ampho, as described in Pear, W. S., Scott, M. L. and Nolan, G. P., Generation of High Titre, Helper-free Retroviruses by Transient Transfection. Methods in Molecular Medicine: Gene Therapy Protocols, Humana Press, Totowa, N.J., pp. 41-57. The *Chlamydia* library in retroviral form was then transduced into H2-Ld expressing P815 cells, which were then used as target cells to stimulate an antigen specific T-cell line.

A *Chlamydia*-specific, murine $H2^d$ restricted CD8+ T-cell line was expanded in culture by repeated rounds of stimulation with irradiated *C. trachomatis*-infected J774 cells and irradiated syngeneic spleen cells, as described by Starnbach, M., in *J. Immunol.*, 153:5183, 1994. This *Chlamydia*-specific T-cell line was used to screen the above *Chlamydia* genomic library expressed by the retrovirally-transduced P815 cells. Positive DNA pools were identified by detection of IFN-γ production using Elispot analysis (SEE Lalvani et al., *J. Experimental Medicine* 186:859-865, 1997).

Two positive pools, referred to as 2C7 and 2E10, were identified by IFN-γ Elispot assays. Stable transductants of P815 cells from pool 2C7 were cloned by limiting dilution and individual clones were selected based upon their capacity to elicit IFN-γ production from the *Chlamydia*-specific CTL line. From this screening process, four positive clones were selected, referred to as 2C7-8, 2C7-9, 2C7-19 and 2C7-21. Similarly, the positive pool 2E10 was further screened, resulting in an additional positive clone, which contains three inserts. The three inserts are fragments of the CT016, tRNA syntase and clpX genes (SEQ ID NO: 268-270, respectively).

Transgenic DNA from these four positive 2C7 clones were PCR amplified using pBIB-KS specific primers to selectively amplify the *Chlamydia* DNA insert. Amplified inserts were gel purified and sequenced. One immunoreactive clone, 2C7-8 (SEQ ID NO: 15, with the predicted amino acid sequence provided in SEQ ID NO: 32), is a 160 bp fragment with homology to nucleotides 597304-597145 of *Chlamydia trachomatis*, serovar D (NCBI, BLASTN search; SEQ ID NO: 33, with the predicted amino acid sequence provided in SEQ ID NO: 34). The sequence of clone 2C7-8 maps within two putative open reading frames from the region of high homology described immediately above, and in particular, one of these putative open reading frames, consisting of a 298 amino acid fragment (SEQ ID NO: 16, with the predicted amino acid sequence provided in SEQ ID NO: 17), was demonstrated to exhibit immunological activity.

Full-length cloning of the 298 amino acid fragment (referred to as CT529 and/or the Cap1 gene) from serovar L2 was obtained by PCR amplification using 5'-ttttgaagcaggtaggtgaatatg (forward) (SEQ ID NO: 159) and 5'-ttaagaaatttaaaaaatccctta (reverse) (SEQ ID NO: 160) primers, using purified *C. trachomatis* L2 genomic DNA as template. This PCR product was gel-purified, cloned into pCRBlunt (Invitrogen, Carlsbad, Calif.) for sequencing, and then subcloned into the EcoRI site of pBIB-KMS, a derivative of pBIB-KS for expression. The *Chlamydia pnuemoniae* homologue of CT529 is provided in SEQ ID NO: 291, with the corresponding amino acid sequence provided in SEQ ID NO: 292.

Full-length DNA encoding various CT529 serovars were amplified by PCR from bacterial lysates containing $10^5$ IFU, essentially as described (Denamur, E., C. Sayada, A. Souriau, J. Orfila, A. Rodolakis and J. Elion. 1991. J. Gen. Microbiol. 137: 2525). The following serovars were amplified as described: Ba (SEQ ID NO: 134, with the corresponding predicted amino acid sequence provided in SEQ ID NO: 135); E (BOUR) and E (MTW447) (SEQ ID NO: 122, with the corresponding predicted amino acid sequence provided in SEQ ID NO: 123); F (NI1) (SEQ ID NO: 128, with the corresponding predicted amino acid sequence provided in SEQ ID NO: 129); G; (SEQ ID NO: 126, with the corresponding predicted amino acid sequence provided in SEQ ID NO: 127); Ia (SEQ ID NO: 124, with the corresponding predicted amino acid sequence provided in SEQ ID NO: 125); L1 (SEQ ID NO: 130, with the corresponding predicted amino acid sequence provided in SEQ ID NO: 131); L3 (SEQ ID NO: 132, with the corresponding predicted amino acid sequence provided in SEQ ID NO: 133); I (SEQ ID NO: 263, with the corresponding predicted amino acid sequence provided in SEQ ID NO: 264); K (SEQ ID NO: 265, with the corresponding predicted amino acid sequence provided in SEQ ID NO: 266); and MoPn (SEQ ID NO: 136, with the corresponding predicted amino acid sequence provided in SEQ ID NO: 137). PCR reactions were performed with Advantage Genomic PCR Kit (Clontech, Palo Alto, Calif.) using primers specific for serovar L2 DNA (external to the ORF). Primers sequences were 5'-ggtataatatctctctcaaattttg (forward—SEQ ID NO: 161) and 5'-agataaaaaaggctgtttc' (reverse—SEQ ID NO: 162) except for MoPn which required 5'-ttttgaagcaggtaggtgaatatg (forward-SEQ ID NO: 163) and 5'-tttacaataagaaaagctaag-cactttgt (reverse—SEQ ID NO: 164). PCR amplified DNA was purified with QIAquick PCR purification kit (Qiagen, Valencia, Calif.) and cloned in pCR2.1 (Invitrogen, Carlsbad, Calif.) for sequencing.

Sequencing of DNA derived from PCR amplified inserts of immunoreactive clones was done on an automated sequencer (ABI 377) using both a pBIB-KS specific forward primer 5'-ccttacacagtcctgctgac (SEQ ID NO: 165) and a reverse primer 3'-gtttccgggccctcacattg (SEQ ID NO: 166). PCRBlunt cloned DNA coding for CT529 serovar L2 and pCR2.1 cloned DNA coding for CT529 serovar Ba, E (BOUR), E (MTW447), F (NI1), G, Ia, K, L1, L3 and MoPn were sequenced using T7 promoter primer and universal M13 forward and M13 reverse primers.

Figure 3:
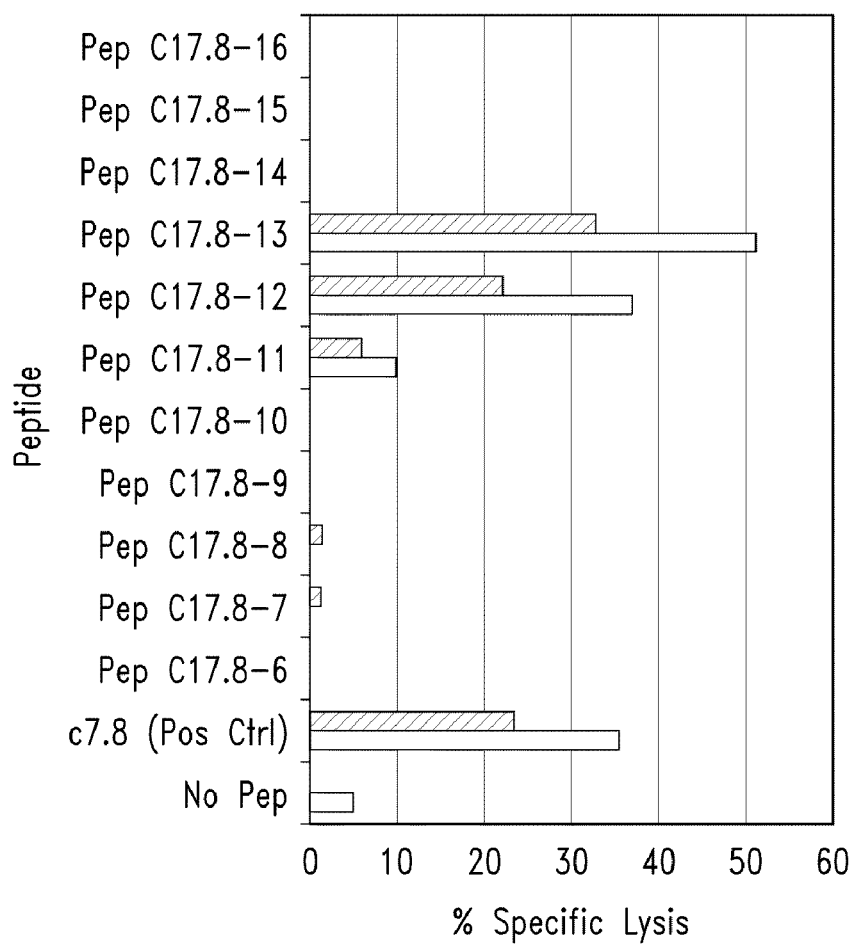
FIG. 3 shows specific lysis in a chromium release assay of P815 cells pulsed with *Chlamydia* peptides CtC7.8-12 (SEQ ID NO: 18) and CtC7.8-13 (SEQ ID NO: 19). Bars represent the specific lysis of the pulsed cells at different effector to target ratios (E:T). At 10:1 E:T (open bar), peptide CtC7.8-12 and peptide CtC7.8-13 elicited a 38% specific lysis and 52% lysis, respectively.

To determine if these two putative open reading frames (SEQ ID NO: 16 and 20) encoded a protein with an associated immunological function, overlapping peptides (17-20 amino acid lengths) spanning the lengths of the two open reading frames were synthesized, as described in Example 3. A standard chromium release assay was utilized to determine the percent specific lysis of peptide-pulsed $H2^d$ restricted target cells. In this assay, aliquots of P815 cells ($H2^d$) were labeled at 37° C. for one hour with 100 µCi of $^{51}$Cr in the presence or absence of 1 µg/ml of the indicated peptides. Following this incubation, labeled P815 cells were washed to remove excess $^{51}$Cr and peptide, and subsequently plated in duplicate in microculture plates at a concentration of 1,000 cells/well. Effector CTL (*Chlamydia*-specific CD8 T cells) were added at the indicated effector:target ratios. Following a 4 hour incubation, supernatants were harvested and measured by gamma-counter for release of $^{51}$Cr into the supernatant. Two overlapping peptides from the 298 amino acid open reading frame did specifically stimulate the CTL line. The peptides represented in SEQ ID NO: 138-156 were synthesized, representing the translation of the L2 homologue of the serovar D open reading frame for CT529 (Cap1 gene) and 216 amino acid open reading frame. As shown in FIG. 3, peptides CtC7.8-12 (SEQ ID NO: 18, also referred to as Cap1#132-147, SEQ ID NO: 139) and CtC7.8-13 (SEQ ID NO: 19, also referred to as Cap1#138-155, SEQ ID NO: 140) were able to elicit 38 to 52% specific lysis, respectively, at an effector to target ratio of 10:1. Notably, the overlap between these two peptides contained a predicted $H2^d$ ($K^d$ and $L^d$) binding peptide. A 10 amino acid peptide was synthesized to correspond to this overlapping sequence (SEQ ID NO: 31) and was found to generate a strong immune response from the anti-*Chlamydia* CTL line by elispot assay. Significantly, a search of the most recent Genbank database revealed no proteins have previously been described for this gene. Therefore, the putative open reading frame encoding clone 2C7-8 (SEQ ID NO: 15) defines a gene which encompasses an antigen from *Chlamydia* capable of stimulating antigen-specific CD8+ T-cells in a MHC-I restricted manner, demonstrating this antigen could be used to develop a vaccine against *Chlamydia*.

To confirm these results and to further map the epitope, truncated peptides (SEQ ID NO: 138-156) were made and tested for recognition by the T-cells in an IFN-g ELISPOT assay. Truncations of either Ser139 (Cap1#140-147, SEQ ID NO: 146) or Leu147 (Cap1#138-146, SEQ ID NO: 147) abrogate T-cell recognition. These results indicate that the 9-mer peptide Cap1#139-147 (SFIGGITYL, SEQ ID NO: 145) is the minimal epitope recognized by the *Chlamydia*-specific T-cells.

Sequence alignments of Cap1 (CT529) from selected serovars of *C. trachomatis* (SEQ ID NO: 121, 123, 125, 127, 129, 131, 133, 135, 137 and 139) shows one of the amino acid differences is found in position 2 of the proposed epitope. The homologous serovar D peptide is SIIGGITYL (SEQ ID NO: 168). The ability of SFIGGITYL and SIIGGITYL to target cells for recognition by the *Chlamydia* specific T-cells was compared. Serial dilutions of each peptide were incubated with P815 cells and tested for recognition by the T-cells in a $^{51}$Cr release assay, as described above. The *Chlamydia*-specific T-cells recognize the serovar L2 peptide at a minimum concentration of 1 nM and the serovar D peptide at a minimum concentration of 10 nM.

Further studies have shown that a Cap1#139-147-specific T-cell clone recognizes *C. trachomatis* infected cells. To confirm that Cap1$_{139-147}$ is presented on the surface of *Chlamydia* infected cells, Balb-3T3 ($H-2^d$) cells were infected with *C. trachomatis* serovar L2 and tested to determine whether these cells are recognized by a CD8+ T-cell clone specific for Cap1#139-147 epitope (SEQ ID NO: 145). The T-cell clone specific for Cap1#139-147 epitope was obtained by limiting dilution of the line 69 T-cells. The T-cell clone specifically recognized the *Chlamydia* infected cells. In these experiments, target cells were *C. trachomatis* infected (positive control) or uninfected Balb/3T3 cells, showing 45%, 36% and 30% specific lysis at 30:1, 10:1 and 3:1 effector to target ratios, respectively; or Cap1#139-147 epitope (SEQ ID NO: 145) coated, or untreated P815 cells, showing 83%, 75% and 58% specific lysis at 30:1, 10:1 and 3:1 effector to target ratios, respectively (negative controls having less than 5% lysis in all cases). This data suggests that the epitope is presented during infection.

In vivo studies show Cap1#139-147 epitope-specific T-cells are primed during murine infection with *C. trachomatis*. To determine if infection with *C. trachomatis* primes a Cap1#139-147 epitope-specific T-cell response, mice were infected i.p. with $10^8$ IFU of *C. trachomatis* serovar L2. Two weeks after infection, the mice were sacrificed and spleen cells were stimulated on irradiated syngeneic spleen cells pulsed with Cap1#139-147 epitope peptide. After 5 days of stimulation, the cultures were used in a standard $^{51}$Cr release assay to determine if there were Cap1#139-147 epitope-specific T-cells present in the culture. Specifically, spleen cells from a *C. trachomatis* serovar L2 immunized mouse or a control mouse injected with PBS after a 5 days culture with Cap1#139-147 peptide-coated syngeneic spleen cells and CD8+ T-cells able to specifically recognize Cap1#139-147 epitope gave 73%, 60% and 32% specific lysis at a30:1, 10:1 and 3:1 effector to target ratios, respectively. The control mice had a percent lysis of approximately 10% at a 30:1 effector to target ratio, and steadily declining with lowering E:T ratios. Target cells were Cap1#139-147 peptide-coated, or untreated P815 cells. These data suggest that Cap1#139-147 peptide-specific T-cells are primed during murine infection with *C. trachomatis*.

Ct529 Localization

Studies were performed demonstrating that Ct529 (referred to herein as Cap-1) localizes to the inclusion membrane of *C. trachomatis*-infected cells and is not associated with elementary bodies or reticulate bodies. As described above, Cap-1 was identified as a product from *Chlamydia* that stimulates CD8+ CTL. These CTL are protective in a murine model of infection, thus making Cap-1 a good vaccine candidate. Further, since these CTL are MHC-I restricted, the Cap-1 gene must have access to the cytosol of infected cells, which may be a unique characteristic of specific Chlamydial gene products. Therefore, determination of the cellular localization of the gene products would be useful in characterizing Cap-1 as a vaccine candidate. To detect the intracellular localization of Cap-1, rabbit polyclonal antibodies directed against a recombinant polypeptide encompassing the N-terminal 125 amino acids of Cap-1 (SEQ ID NO: 305, with the amino acid sequence including the N-terminal 6-His tag provided in SEQ ID NO: 304) were used to stain McCoy cells infected with Chlamydiae.

Rabbit-anti-Cap-1 polyclonal antibodies were obtained by hyper-immunization of rabbits with a recombinant polypeptide, rCt529c1-125 (SEQ ID NO: 305) encompassing the N-terminal portion of Cap-1. Recombinant rCt529e1-125 protein was obtained from *E. coli* transformed with a pET expression plasmid (as described above) encoding the nucleotides 1-375 encoding the N-terminal 1-125 amino acids of Cap-1. Recombinant protein was purified by Ni-NTA using techniques well known in the art. For a positive control antiserum, polyclonal antisera directed against elementary bodies were made by immunization of rabbits with purified *C. trachomatis* elementary bodies (Biodesign, Sacco, Me.). Preimmune sera derived from rabbits prior to immunization with the Cap-1 polypeptide was used as a negative control.

Immunocytochemistry was performed on McCoy cell monolayers grown on glass coverslips inoculated with either *C. trachomatis* serovar L2 or *C. psitacci*, strain 6BC, at a concentration of $10^6$ IFU (Inclusion Forming Units) per ml. After 2 hours, medium was aspirated and replaced with fresh RP-10 medium supplemented with cycloheximide (1.0 μg/ml). Infected cells were incubated at in 7% $CO_2$ for 24 hours and fixed by aspirating medium, rinsing cells once with PBS and methanol fixation for 5 minutes. For antigen staining, fixed cell monolayers were washed with PBS and incubated at 37° C. for 2 hours with 1:100 dilutions of specific or control antisera. Cells were rinsed with PBS and incubated for 1 hour with fluorescein isothiocyanate (FITC)-labeled, anti-rabbit IgG (KPL, Gaithersburg) and stained with Evans blue (0.05%) in PBS. Fluorescence was observed with a 100× objective (Zeiss epifluorescence microscope), and photographed (Nikon UFX-11A camera).

Results from this study show Cap-1 localizes to the inclusion membrane of *C. trachomatis*-infected cells. Cap-1 specific antibody labeled the inclusion membranes of *C. trachomatis*-infected cells, but not Chlamydial elementary bodies contained in these inclusions or released by the fixation process. Conversely, the anti-elementary body antibody clearly labeled the bacterial bodies, not only within the inclusions, but those released by the fixation process. Specificity of the anti-Cap-1 antibody is demonstrated by the fact that it does not stain *C. psittaci*-infected cells. Specificity of the Cap-1 labeling is also shown by the absence of reactivity in pre-immune sera. These results suggest that Cap-1 is released from the bacteria and becomes associated with the Chlamydial inclusion membrane. Therefore, Cap-1 is a gene product which may be useful for stimulating CD8+ T cells in the development of a vaccine against infections caused by *Chlamydia*.

The relevance of the Cap-1 gene as a potential CTL antigen in a vaccine against *Chlamydia* infection is further illustrated by two additional series of studies. First, CTL specific for the MHC-I epitope of Cap-1 CT529 #138-147 peptide of *C. trachomatis* (SEQ ID NO: 144) have been shown to be primed to a high frequency during natural infection. Specifically, Balb/C mice were inoculated with $10^6$ I.F.U. of *C. trachomatis*, serova L2. After 2 weeks, spleens were harvested and quantified by Elispot analysis for the number of IFN-γ secreting cells in response to Cap-1 #138-147 peptide-pulsed antigen presenting cells. In two experiments, the number of IFN-γ-secreting cells in $10^5$ splenocytes was about 1% of all CD8+ T-cells. This high frequency of responding CD8+ CTL to the MHC-1 epitope (Cap-1 CT529 #138-147 peptide) suggest that Cap-1 is highly immunogenic in infections.

Results from a second series of studies have shown that the Cap-1 protein is almost immediately accessible to the cytosol of the host cell upon infection. This is shown in a time-course of Cap-1 CT529 #138-147 peptide presentation. Briefly, 3T3 cells were infected with *C. trachomatis* serovar L2 for various lengths of time, and then tested for recognition by Cap-1 CT529 #138-147 peptide-specific CTL. The results show that *C. trachomatis-infected* 3T3 cells are targeted for recognition by the antigen-specific CTL after only 2 hours of infection. These results suggest that Cap-1 is an early protein synthesized in the development of *C. trachomatis* elementary bodies to reticulate bodies. A CD8+ CTL immune response directed against a gene product expressed early in infection may be particularly efficacious in a vaccine against *Chlamydia* infection.

Example 5

Figure 4:
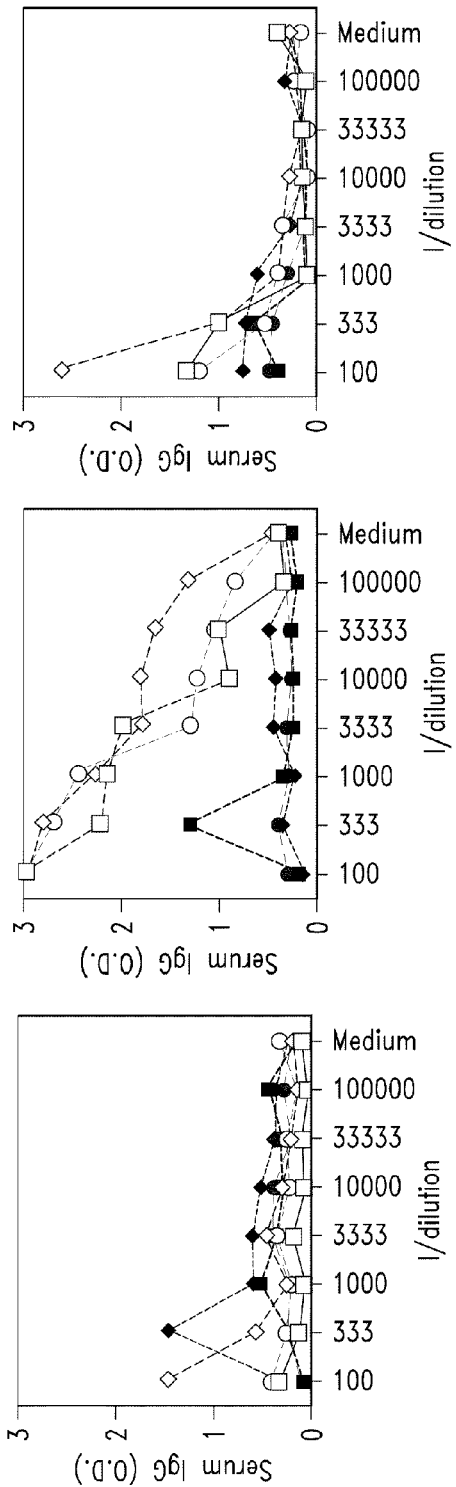
FIG. 4 shows antibody isotype titers in C57B1/6 mice immunized with *C. trachomatis* SWIB protein.

Generation of Antibody and T-Cell Responses in Mice Immunized with *Chlamydia* Antigens Immunogenicity studies were conducted to determine the antibody and CD4+ T cell responses in mice immunized with either purified SWIB or S13 proteins formulated with Montanide adjuvant, or DNA-based immunizations with pcDNA-3 expression vectors containing the DNA sequences for SWIB or S13. SWIB is also referred to as clone 1-B1-66 (SEQ ID NO: 1, with the corresponding amino acid sequence provided in SEQ ID NO: 5), and S13 ribosomal protein is also referred to as clone 10-C10C-31 (SEQ ID NO: 4, with the corresponding amino acid sequence provided in SEQ ID NO: 12). In the first experiment, groups of three C57BL/6 mice were immunized twice and monitored for antibody and CD4+ T-cell responses. DNA immunizations were intradermal at the base of the tail and polypeptide immunizations were administered by subcutaneous route. Results from standard $^3$H-incorporation assays of spleen cells from immunized mice shows a strong proliferative response from the group immunized with purified recombinant SWIB polypeptide (SEQ ID NO: 5). Further analysis by cytokine induction assays, as previously described, demonstrated that the group immunized with SWIB polypeptide produced a measurable IFN-γ and IL-4 response. Subsequent ELISA-based assays to determine the predominant antibody isotype response in the experimental group immunized with the SWIB polypeptide were performed. FIG. 4 illustrates the SWIB-immunized group gave a humoral response that was predominantly IgG1.

Figure 5:
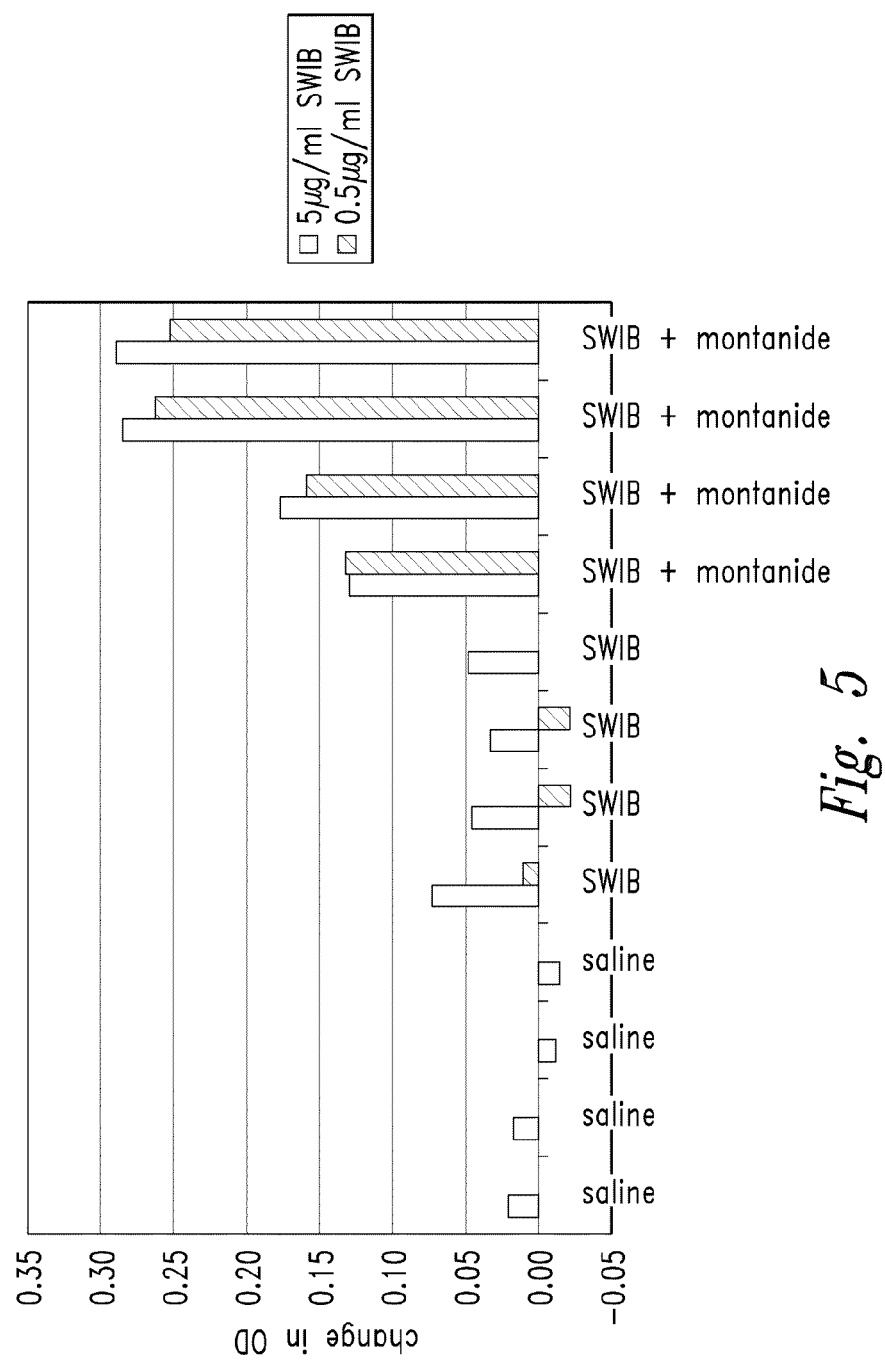
FIG. 5 shows *Chlamydia*-specific T-cell proliferative responses in splenocytes from C3H mice immunized with *C. trachomatis* SWIB protein.
Figure 7A:
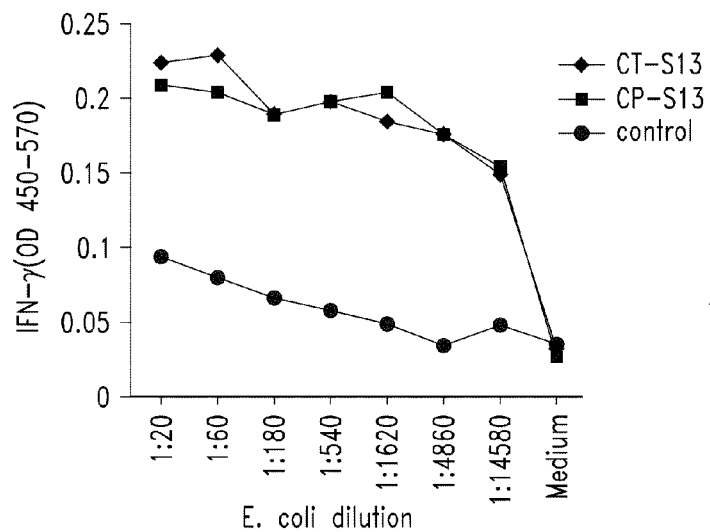
FIGS. 7A and 7B show induction of IFN-γ from a human anti-chlamydia T-cell line (TCL-8) capable of cross-reacting to *C. trachomatis* and *C. pneumonia* upon activation by monocyte-derived dendritic cells expressing chlamydial proteins.
Figure 7B:
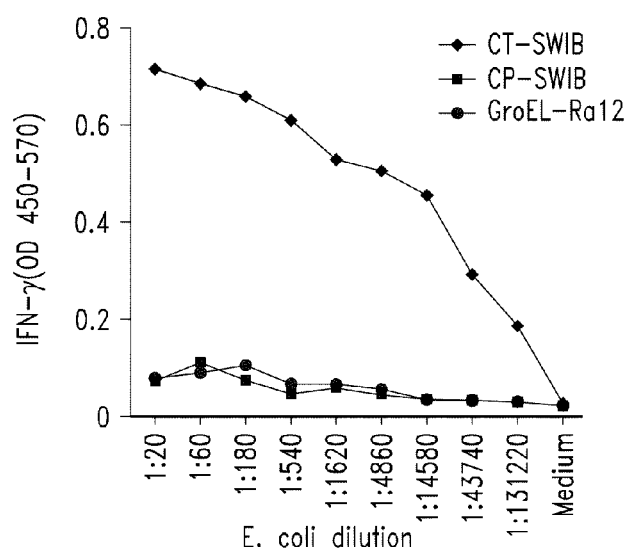
Figure 8:
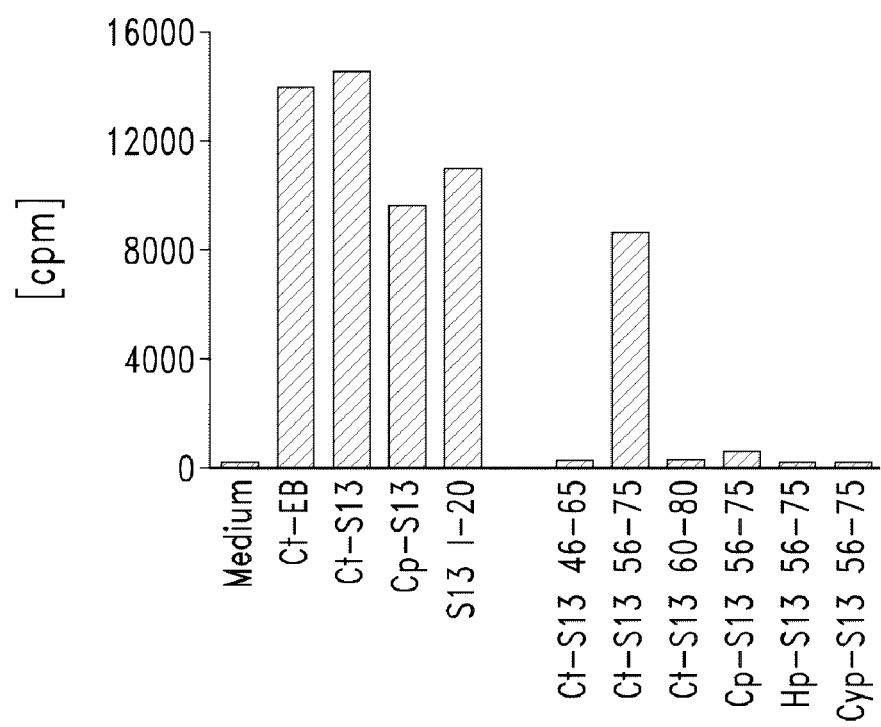
FIG. 8 shows the identification of T cell epitopes in Chlamydial ribosomal S13 protein with T-cell line TCL 8 EB/DC.
Figure 9B:
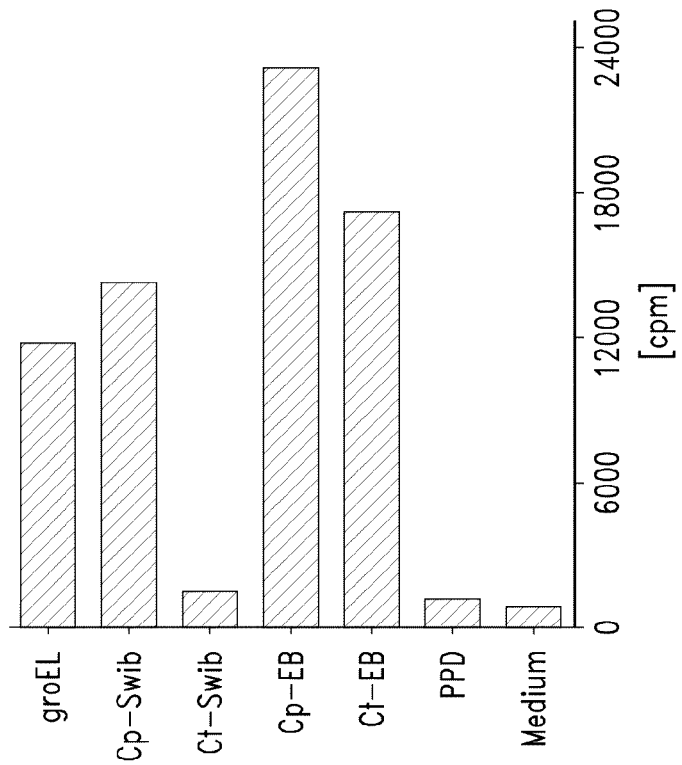
FIG. 9 illustrates the proliferative response of CP-21 T-cells generated against *C. pnuemoniae*-infected dendritic cells to recombinant *C. pneumonia*-SWIB protein, but not *C. trachomatis* SWIB protein.
Figure 9A:
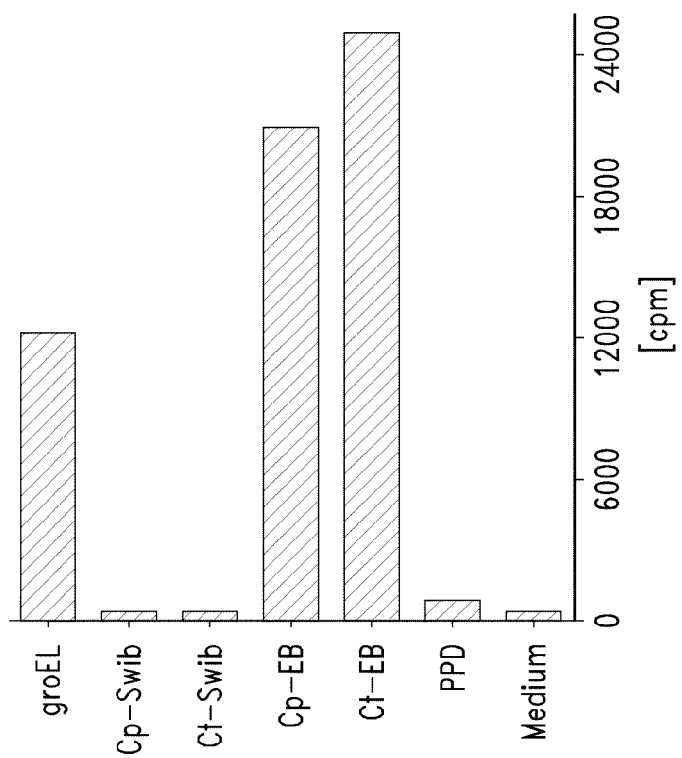

In a second experiment, C3H mice were immunized three times with 10 μg purified SWIB protein (also referred to as clone 1-B1-66, SEQ ID NO: 5) formulated in either PBS or Montanide at three week intervals and harvested two weeks after the third immunization. Antibody titers directed against the SWIB protein were determined by standard ELISA-based techniques well known in the art, demonstrating the SWIB protein formulated with Montanide adjuvant induced a strong humoral immune response. T-cell proliferative responses were determined by a XTT-based assay (Scudiero, et al, *Cancer Research*, 1988, 48:4827). As shown in FIG. 5, splenocytes from mice immunized with the SWIB polypeptide plus Montanide elicited an antigen specific proliferative response. In addition, the capacity of splenocytes from immunized animals to secrete IFN-γ in response to soluble recombinant SWIB polypeptide was determined using the cytokine induction assay previously described. The splenocytes from all animals in the group immunized with SWIB polypeptide formulated with montanide adjuvant secreted IFN-γ in response to exposure to the SWIB *Chlamydia* antigen, demonstrating an *Chlamydia*-specific immune response.

In a further experiment, C3H mice were immunized at three separate time points at the base of the tail with 10 μg of purified SWIB or S13 protein (*C. trachomatis*, SWIB protein, clone 1-B1-66, SEQ ID NO: 5, and S13 protein, clone 10-C10-31, SEQ ID NO: 4) formulated with the SBAS2 adjuvant (SmithKline Beecham, London, England). Antigen-specific antibody titers were measured by ELISA, showing both polypeptides induced a strong IgG response, ranging in titers from $1 \times 10^{-4}$ to $1 \times 10^{-5}$. The IgG1 and IgG2a components of this response were present in fairly equal amounts. Antigen-specific T-cell proliferative responses, determined by standard $^3$H-incorporation assays on spleen cells isolated from immunized mice, were quite strong for SWIB (50,000 cpm above the negative control) and even stronger for s13 (100,000 cpm above the negative control). The IFNγ production was assayed by standard ELISA techniques from supernatant from the proliferating culture. In vitro restimulation of the culture with S13 protein induced high levels of IFNγ production, approximately 25 ng/ml versus 2 ng/ml for the negative control. Restimulation with the SWIB protein also induced IFNγ, although to a lesser extent.

In a related experiment, C3H mice were immunized at three separate time points with 10 μg of purified SWIB or S13 protein (*C. trachomatis*, SWIB protein, clone 1-B1-66, SEQ ID NO: 5, and S13 protein, clone 10-C10-31, SEQ ID NO: 4) mixed with 10 μg of Cholera Toxin. Mucosal immunization was through intranasal inoculation. Antigen-specific antibody responses were determined by standard ELISA techniques. Antigen-specific IgG antibodies were present in the blood of SWIB-immunized mice, with titers ranging from $1 \times 10^{-3}$ to $1 \times 10^{-4}$, but non-detectable in the S13-immunized animals. Antigen-specific T-cell responses from isolated splenocytes, as measured by IFNγ production, gave similar results to those described immediately above for systemic immunization.

An animal study was conducted to determine the immunogenicity of the CT529 serovar LGVII CTL epitope, defined by the CT529 10mer consensus peptide (CSFIGGITYL—SEQ ID NO: 31), which was identified as an H2-Kd restricted CTL epitope. BALB/c mice (3 mice per group) were immunized three times with 25 μg of peptide combined with various adjuvants. The peptide was administered systemically at the base of the tail in either SKB Adjuvant System SBAS-2", SBAS-7 (SmithKline Beecham, London, England) or Montanide. The peptide was also administered intranasally mixed with 10 ug of Cholera Toxin (CT). Naive mice were used as a control. Four weeks after the 3rd immunization, spleen cells were restimulated with LPS-blasts pulsed with 10 ug/ml CT529 10mer consensus peptide at three different effector to LPS-blasts ratios: 6, 1.5 and 0.4 at $1 \times 10^6$ cell/ml. After 2 restimulations, effector cells were tested for their ability to lyse peptide pulsed P815 cells using a standard chromium release assay. A non-relevant peptide from chicken egg ovalbumin was used as a negative control. The results demonstrate that a significant immune response was elicited towards the CT529 10mer consensus peptide and that antigen-specific T-cells capable of lysing peptide-pulsed targets were elicited in response to immunization with the peptide. Specifically, antigen-specific lytic activities were found in the SBAS-7 and CT adjuvanted group while Montanide and SBAS-2" failed to adjuvant the CTL epitope immunization.

Example 6

Expression and Characterization of *Chlamydia Pneumoniae* Genes

The human T-cell line, TCL-8, described in Example 1, recognizes *Chlamydia trachomatis* as well as *Chlamydia pneumonia* infected monocyte-derived dendritic cells, suggesting *Chlamydia trachomatis* and pneumonia may encode cross-reactive T-cell epitopes. To isolate the *Chlamydia pneumonia* genes homologous to *Chlamydia trachomatis* LGV II clones 1B 1-66, also referred to as SWIB (SEQ ID NO: 1) and clone 10C10-31, also referred to as S13 ribosomal protein (SEQ ID NO: 4), HeLa 229 cells were infected with *C. pneumonia* strain TWAR(CDC/CWL-029). After three days incubation, the *C. pneumonia*-infected HeLa cells were harvested, washed and resuspended in 200 μl water and heated in a boiling water bath for 20 minutes. Ten microliters of the disrupted cell suspension was used as the PCR template.

*C. pneumonia* specific primers were designed for clones 1B1-66 and 10C10-31 such that the 5' end had a 6×-Histidine tag and a Nde I site inserted, and the 3' end had a stop codon and a BamHI site included (FIG. 6). The PCR products were amplified and sequenced by standard techniques well known in the art. The *C. pneumonia*-specific PCR products were cloned into expression vector pET17B (Novagen, Madison, Wis.) and transfected into *E. coli* BL21 pLysS for expression and subsequent purification utilizing the histidine-nickel chromatographic methodology provided by Novagen. Two proteins from *C. pneumonia* were thus generated, a 10-11 kDa protein referred to as CpSWIB (SEQ ID NO: 27, and SEQ ID NO: 78 having a 6×His tag, with the corresponding amino acid sequence provided in SEQ ID NO: 28, respectively), a 15 kDa protein referred to as CpS13 (SEQ ID NO: 29, and SEQ ID NO: 77, having a 6×His tag, with the corresponding amino acid sequence provided in SEQ ID NO: 30 and 91, respectively).

Example 7

Induction of T Cell Proliferation and Interferon-γProduction by *Chlamydia Pneumoniae* Antigens The ability of recombinant *Chlamydia pneumoniae* antigens to induce T cell proliferation and interferon-γ production is determined as follows.

Proteins are induced by IPTG and purified by Ni-NTA agarose affinity chromatography (Webb et al., *J. Immunology* 157:5034-5041, 1996). The purified polypeptides are then screened for the ability to induce T-cell proliferation in PBMC preparations. PBMCs from *C. pneumoniae* patients as well as from normal donors whose T-cells are known to proliferate in response to *Chlamydia* antigens, are cultured in medium comprising RPMI 1640 supplemented with 10% pooled human serum and 50 μg/ml gentamicin. Purified polypeptides are added in duplicate at concentrations of 0.5 to 10 μg/mL. After six days of culture in 96-well round-bottom plates in a volume of 200 μl, 50 μl of medium is removed from each well for determination of IFN-γ levels, as described below. The plates are then pulsed with 1 μCi/well of tritiated thymidine for a further 18 hours, harvested and tritium uptake determined using a gas scintillation counter. Fractions that result in proliferation in both replicates three fold greater than the proliferation observed in cells cultured in medium alone are considered positive.

IFN-γ was measured using an enzyme-linked immunosorbent assay (ELISA). ELISA plates are coated with a mouse monoclonal antibody directed to human IFN-γ (PharMingen, San Diego, Calif.) in PBS for four hours at room temperature. Wells are then blocked with PBS containing 5% (W/V) non-fat dried milk for 1 hour at room temperature. The plates are washed six times in PBS/0.2% TWEEN-20 and samples diluted 1:2 in culture medium in the ELISA plates are incubated overnight at room temperature. The plates are again washed and a polyclonal rabbit anti-human IFN-γ serum diluted 1:3000 in PBS/10% normal goat serum is added to each well. The plates are then incubated for two hours at room temperature, washed and horseradish peroxidase-coupled anti-rabbit IgG (Sigma Chemical So., St. Louis, Mo.) is added at a 1:2000 dilution in PBS/5% non-fat dried milk. After a further two hour incubation at room temperature, the plates are washed and TMB substrate added. The reaction is stopped after 20 min with 1 N sulfuric acid. Optical density is determined at 450 nm using 570 nm as a reference wavelength. Fractions that result in both replicates giving an OD two fold greater than the mean OD from cells cultured in medium alone, plus 3 standard deviations, are considered positive.

A human anti-*Chlamydia* T-cell line (TCL-8) capable of cross-reacting to *C. trachomatis* and *C. pneumonia* was used to determine whether the expressed proteins described in the example above, (i.e., CpSWIB, SEQ ID NO: 27, and SEQ ID NO: 78 having a 6×His tag, with the corresponding amino acid sequence provided in SEQ ID NO: 28, respectively, and the 15 kDa protein referred to as CpS13 SEQ ID NO: 29, and SEQ ID NO: 77, having a 6×His tag, with the corresponding amino acid sequence provided in SEQ ID NO: 30 and 91, respectively), possessed T-cell epitopes common to both *C. trachomatis* and *C. pneumonia*. Briefly, *E. coli* expressing Chlamydial proteins were titered on $1\times10^4$ monocyte-derived dendritic cells. After two hours, the dendritic cells cultures were washed and $2.5\times10^4$ T cells (TCL-8) added and allowed to incubate for an additional 72 hours. The amount of INF-γ in the culture supernatant was then determined by ELISA. As shown in FIGS. 7A and 7B, the TCL-8 T-cell line specifically recognized the S13 ribosomal protein from both *C. trachomatis* and *C. pneumonia* as demonstrated by the antigen-specific induction of IFN-γ, whereas only the SWIB protein from *C. trachomatis* was recognized by the T-cell line. To validate these results, the T cell epitope of *C. trachomatis* SWIB was identified by epitope mapping using target cells pulsed with a series of overlapping peptides and the T-cell line TCL-8. 3H-thymidine incorporation assays demonstrated that the peptide, referred to as C.t.SWIB 52-67, of SEQ ID NO: 39 gave the strongest proliferation of the TCL-8 line. The homologous peptides corresponding to the SWIB of *C. pneumoniae* sequence (SEQ ID NO: 40), the topoisomerase-SWIB fusion of *C. pneumoniae* (SEQ ID NO: 43) and *C. trachomatis* (SEQ ID NO: 42) as well as the human SWI domain (SEQ ID NO: 41) were synthesized and tested in the above assay. The T-cell line TCL-8 only recognized the *C. trachomatis* peptide of SEQ ID NO: 39 and not the corresponding *C. pneumoniae* peptide (SEQ ID NO: 40), or the other corresponding peptides described above (SEQ ID NO; 41-43).

*Chlamydia*-specific T cell lines were generated from donor CP-21 with a positive serum titer against *C. pneumoniae* by stimulating donor PBMC with either *C. trachomatis* or *C. pneumoniae*-infected monocyte-derived dendritic cells, respectively. T-cells generated against *C. pneumoniae* responded to recombinant *C. pneumoniae*-SWIB but not *C. trachomatis*-SWIB, whereas the T-cell line generated against *C. trachomatis* did not respond to either *C. trachomatis*- or *C. pneumoniae*-SWIB (see FIG. 9). The *C. pneumoniae*-SWIB specific immune response of donor CP-21 confirms the *C. pneumoniae* infection and indicates the elicitation of *C. pneumoniae*-SWIB specific T-cells during in vivo *C. pneumoniae* infection.

Epitope mapping of the T-cell response to *C. pneumoniae*-SWIB has shown that Cp-SWIB-specific T-cells responded to the overlapping peptides Cp-SWIB 32-51 (SEQ ID NO: 101) and Cp-SWIB 37-56 (SEQ ID NO: 102), indicating a *C. pneumoniae*-SWIB-specific T-cell epitope Cp-SWIB 37-51 (SEQ ID NO: 100).

In additional experiments, T-cell lines were generated from donor CP1, also a *C. pneumoniae* seropositive donor, by stimulating PBMC with non-infectious elementary bodies from *C. trachomatis* and *C. pneumoniae*, respectively. In particular, proliferative responses were determined by stimulating $2.5\times10^4$ T-cells in the presence of $1\times10^4$ monocyte-derived dendritic cells and non-infectious elementary bodies derived from *C. trachomatis* and *C. pneumoniae*, or either recombinant *C. trachomatis* or *C. pneumoniae* SWIB protein.

The T-cell response against SWIB resembled the data obtained with T-cell lines from CP-21 in that C. pneumoniae-SWIB, but not C. trachomatis-SWIB elicited a response by the C. pneumoniae T-cell line. In addition, the C. trachomatis T-cell line did not proliferate in response to either C. trachomatis or C. pneumoniae SWIB, though it did proliferate in response to both CT and CP elementary bodies. As described in Example 1, Clone 11-C12-91 (SEQ ID NO: 63), identified using the TCP-21 cell line, has a 269 bp insert that is part of the OMP2 gene (CT443) and shares homology with the 60 kDa cysteine rich outer membrane protein of C. pneumoniae, referred to as OMCB. To further define the reactive epitope(s), epitope mapping was performed using a series of overlapping peptides and the immunoassay previously described. Briefly, proliferative responses were determined by stimulating $2.5 \times 10^4$ TCP-21 T-cells in the presence of $1 \times 10^4$ monocyte-derived dendritic cells with either non-infectious elementary bodies derived from C. trachomatis and C. pneumoniae, or peptides derived from the protein sequence of C. trachomatis or C. pneumoniae OMCB protein (0.1 µg/ml). The TCP-21 T-cells responded to epitopes CT-OMCB #167-186, CT-OMCB #171-190, CT-OMCB #171-186, and to a lesser extent, CT-OMCB #175-186 (SEQ ID NO: 249-252, respectively). Notably, the TCP-21 T-cell line also gave a proliferative response to the homologous C. pneumoniae peptide CP-OMCB #171-186 (SEQ ID NO: 253), which was equal to or greater than the response to the to the C. trachomatis peptides. The amino acid substitutions in position two (i.e., Asp for Glu) and position four (i.e., Cys for Ser) did not alter the proliferative response of the T-cells and therefore demonstrating this epitope to be a cross-reactive epitope between C. trachomatis and C. pneumoniae.

Example 8

Immune Responses of Human PBMC and T-Cell Lines Against Chlamydia Antigens

The examples provided herein suggest that there is a population of healthy donors among the general population that have been infected with C. trachomatis and generated a protective immune response controlling the C. trachomatis infection. These donors remained clinically asymptomatic and seronegative for C. trachomatis. To characterize the immune responses of normal donors against chlamydial antigens which had been identified by CD4 expression cloning, PBMC obtained from 12 healthy donors were tested against a panel of recombinant chlamydial antigens including C. trachomatis-, C. pneumoniae-SWIB and C. trachomatis-, C. pneumoniae-S13. The data are summarized in Table I below. All donors were seronegative for C. trachomatis, whereas 6/12 had a positive C. pneumoniae titer. Using a stimulation index of >4 as a positive response, 11/12 of the subjects responded to C. trachomatis elementary bodies and 12/12 responded to C. pneumoniae elementary bodies. One donor, AD104, responded to recombinant C. pneumoniae-S13 protein, but not to recombinant C. trachomatis-S13 protein, indicating a C. pneumoniae-specific response. Three out of 12 donors had a C. trachomatis-SWIB, but not a C. pneumoniae-SWIB specific response, confirming a C. trachomatis infection. C. trachomatis and C. pneumoniae-S13 elicited a response in 8/12 donors suggesting a chlamydial infection. These data demonstrate the ability of SWIB and S13 to elicit a T-cell response in PBMC of normal study subjects.

TABLE I

Immune response of normal study subjects against Chlamydia

| Donor | Sex | Chlamydia IgG titer | CT EB | CP EB | CT Swib | CP Swib | CT S13 | CP S13 | CT lpdA | CT TSA |
|---|---|---|---|---|---|---|---|---|---|---|
| AD100 | male | negative | ++ | +++ | + | − | ++ | ++ | − | n.t. |
| AD104 | female | negative | +++ | ++ | − | − | − | ++ | − | n.t. |
| AD108 | male | CP 1:256 | ++ | ++ | + | +/− | + | + | + | n.t. |
| AD112 | female | negative | ++ | ++ | + | − | + | − | +/− | n.t. |
| AD120 | male | negative | − | + | − | − | − | − | − | n.t. |
| AD124 | female | CP 1:128 | ++ | ++ | − | − | − | − | − | n.t. |
| AD128 | male | CP 1:512 | + | ++ | − | − | ++ | + | ++ | − |
| AD132 | female | negative | ++ | ++ | − | − | + | + | − | − |
| AD136 | female | CP 1:128 | + | ++ | − | − | +/− | − | − | − |
| AD140 | male | CP 1:256 | ++ | ++ | − | − | + | + | − | − |
| AD142 | female | CP 1:512 | ++ | ++ | − | − | + | + | + | − |
| AD146 | female | negative | ++ | ++ | − | − | ++ | + | + | − |

CT = Chlamydia trachomatis; CP = Chlamydia pneumoniae; EB = Chlamydia elementary bodies; Swib = recombinant Chlamydia Swib protein; S13 = recombinant Chlamydia S13 protein; lpdA = recombinant Chlamydia lpdA protein; TSA = recombinant Chlamydia TSA protein.
Values represent results from standard proliferation assays. Proliferative responses were determined by stimulating $3 \times 10^5$ PBMC with $1 \times 10^4$ monocyte-derived dendritic cells pre-incubated with the respective recombinant antigens or elementary bodies (EB). Assays were harvested after 6 days with a $^3$H-thymidine pulse for the last 18 h.
SI: Stimulation index
+/−: SI~4
+: SI > 4
++: SI 10-30
+++: SI > 30

Figure 10:
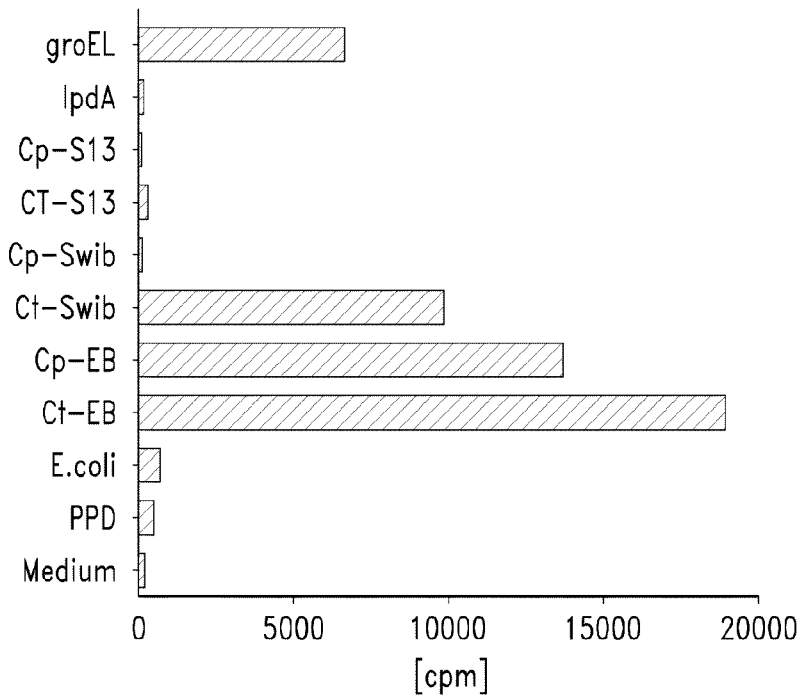
FIG. 10 shows the *C. trachomatis*-specific SWIB proliferative responses of a primary T-cell line (TCT-10 EB) from an asymptomatic donor.
Figure 11:
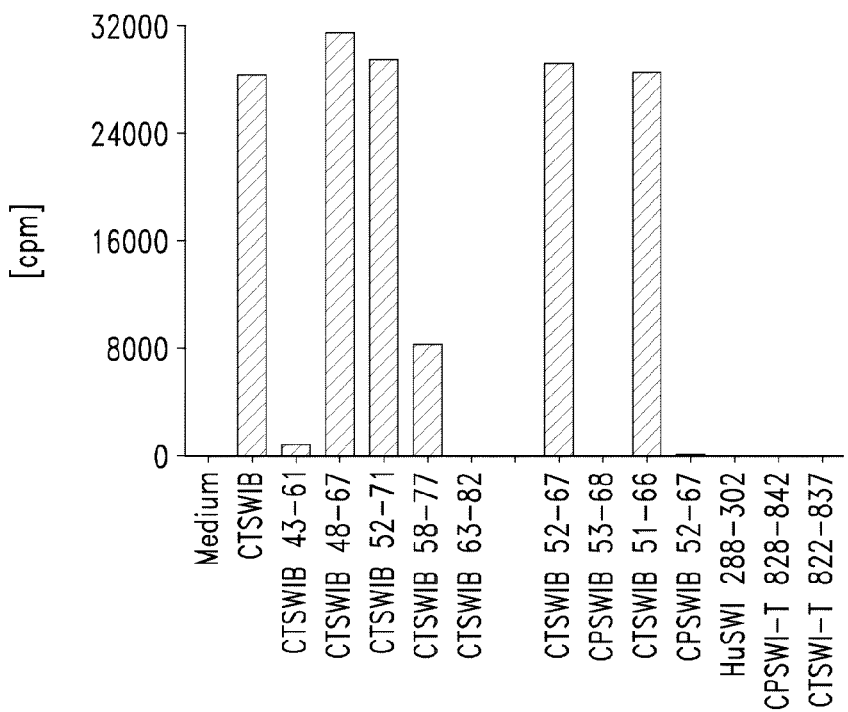
FIG. 11 illustrates the identification of T-cell epitope in *C. trachomatis* SWIB with an antigen specific T-cell line (TCL-10 EB).

In a first series of experiments, T-cell lines were generated from a healthy female individual (CT-10) with a history of genital exposure to C. trachomatis by stimulating T-cells with C. trachomatis LGV II elementary bodies as previously described. Although the study subject was exposed to C. trachomatis, she did not seroconvert and did not develop clinical symptoms, suggesting donor CT-10 may have developed a protective immune response against C. trachomatis. As shown in FIG. 10, a primary Chlamydia-specific T-cell line derived from donor CT-10 responded to C. trachomatis-SWIB, but not C. pneumoniae-SWIB recombinant proteins, confirming the exposure of CT-10 to C. trachomatis. Epitope mapping of the T-cell response to C. trachomatis-SWIB showed that this donor responded to the same epitope Ct-SWIB 52-67 (SEQ ID NO: 39) as T-cell line TCL-8, as shown in FIG. 11.

Additional T-cell lines were generated as described above for various *C. trachomatis* patients. A summary of the patients' clinical profile and proliferative responses to various *C. trachomatis* and *C. pneumoniae* elementary bodies and recombinant proteins are summarized in Table II as follows:

of *C. trachomatis*. These results demonstrate that the *C. trachomatis* and *C. pneumonia* S13 antigen, *C. trachomatis* Swib antigen and the *C. trachomatis* lpdA antigen are recognized by the asymptomatic donors, indicating these antigens were recognized during exposure to *Chlamydia* and an

| | | | Proliferative response of *C. trachomatis* patients | | | | | | | |
|---|---|---|---|---|---|---|---|---|---|---|
| Patients | Clinical manifestation | IgG titer | CT EB | CP EB | CT Swib | CP Swib | CT S13 | CP S13 | CT lpdA | CT TSA |
| CT-1 | NGU | negative | + | + | − | − | ++ | ++ | ++ | + |
| CT-2 | NGU | negative | ++ | ++ | − | − | + | +/− | − | − |
| CT-3 | asymptomatic shed Eb Dx was HPV | Ct 1:512 Cp 1:1024 Cps 1:256 | + | + | − | − | + | − | + | − |
| CT-4 | asymptomatic shed Eb | Ct 1:1024 | + | + | − | − | − | − | − | − |
| CT-5 | BV | Ct 1:256 Cp 1:256 | ++ | ++ | − | − | + | − | − | − |
| CT-6 | perinial rash discharge | Cp 1:1024 | + | + | − | − | − | − | − | − |
| CT-7 | BV genital ulcer | Ct 1:512 Cp 1:1024 | + | + | − | − | + | + | + | − |
| CT-8 | Not known | Not tested | ++ | ++ | − | − | − | − | − | − |
| CT-9 | asymptomatic | Ct 1:128 Cp 1:128 | +++ | ++ | − | − | ++ | + | + | − |
| CT-10 | Itch mild vulvar | negative | ++ | ++ | − | − | − | − | − | − |
| CT-11 | BV, abnormal pap | Ct 1:512 | +++ | +++ | − | − | +++ | +/− | ++ | + |
| CT-12 | asymptomatic | Cp 1:512 | ++ | ++ | − | − | ++ | + | + | − |

NGU = Non-Gonococcal Urethritis; BV = Bacterial Vaginosis; CT = *Chlamydia trachomatis*; CP = *Chlamydia pneumoniae*; EB = *Chlamydia* elementary bodies; Swib = recombinant *Chlamydia* Swib protein; S13 = recombinant *Chlamydia* S13 protein; lpdA = recombinant *Chlamydia* lpdA protein; TSA = recombinant *Chlamydia* TSA protein
Values represent results from standard proliferation assays. Proliferative responses were determined by stimulating $3 \times 10^5$ PBMC with the respective recombinant antigens or elementary bodies (EB). Assays were harvested after 6 days with a $^3$H-thymidine pulse for the last 18 hours.
SI: Stimulation index
+/−: SI~4
+: SI > 4
++: SI 10-30
+++: SI > 30

Using the panel of asymptomatic (as defined above) study subjects and *C. trachomatis* patients, as summarized in Tables I and II, a comprehensive study of the immune responses of PBMC derived from the two groups was conducted. Briefly, PBMCs from *C. pneumoniae* patients as well as from normal donors are cultured in medium comprising RPMI 1640 supplemented with 10% pooled human serum and 50 μg/ml gentamicin. Purified polypeptides, a panel of recombinant chlamydial antigens including *C. trachomatis*-, *C. pneumoniae*-SWIB and S13, as well as *C. trachomatis* lpdA and TSA are added in duplicate at concentrations of 0.5 to 10 μg/mL. After six days of culture in 96-well round-bottom plates in a volume of 200 μl, 50 μl of medium is removed from each well for determination of IFN-γ levels, as described below. The plates are then pulsed with 1 μCi/well of tritiated thymidine for a further 18 hours, harvested and tritium uptake determined using a gas scintillation counter. Fractions that result in proliferation in both replicates three fold greater than the proliferation observed in cells cultured in medium alone are considered positive.

Proliferative responses to the recombinant Chlamydiae antigens demonstrated that the majority of asymptomatic donors and *C. trachomatis* patients recognized the *C. trachomatis* S13 antigen (8/12) and a majority of the *C. trachomatis* patients recognized the *C. pneumonia* S13 antigen (8/12), with 4/12 asymptomatic donors also recognizing the *C. pneumonia* S13 antigen. Also, six out of twelve of the *C. trachomatis* patients and four out of twelve of the asymptomatic donors gave a proliferative response to the lpdA antigen immune response elicited against them. This implies these antigens may play a role in conferring protective immunity in a human host. In addition, the *C. trachomatis* and *C. pneumonia* S13 antigen is recognized equally well among the *C. trachomatis* patients, therefore indicating there may be epitopes shared between *C. trachomatis* and *C. pneumonia* in the S13 protein. Table III summarizes the results of these studies.

TABLE III

| Antigen | Normal Donors | C.t. Patients |
|---|---|---|
| C.t.-Swib | 3/12 | 0/12 |
| C.p.-Swib | 0/12 | 0/12 |
| C.t.-S13 | 8/12 | 8/12 |
| C.p.-S13 | 4/12 | 8/12 |
| lpdA | 4/12 | 6/12 |
| TSA | 0/12 | 2/12 |

A series of studies were initiated to determine the cellular immune response to short-term T-cell lines generated from asymptomatic donors and *C. trachomatis* patients. Cellular immune responses were measured by standard proliferation assays and IFN-γ, as described in Example 7. Specifically, the majority of the antigens were in the form of single *E. coli* clones expressing Chlamydial antigens, although some recombinant proteins were also used in the assays. The single *E. coli* clones were titered on $1 \times 10^4$ monocyte-derived dendritic cells and after two hours, the culture was washed and $2.5 \times 10^4$ T-cells were added. The assay using the recombinant proteins were performed as previously described. Proliferation was determined after four days with a standard $^3$H-thymidine pulse for the last 18 hours. Induction of IFN-γ was determined from culture supernatants harvested after four days using standard ELISA assays, as described above. The results show that all the C. trachomatis antigens tested, except for C.T. Swib, elicited a proliferative response from one or more different T-cell lines derived form C. trachomatis patients. In addition, proliferative responses were elicited from both the C. trachomatis patients and asymptomatic donors for the following Chlamydia genes, CT622, groEL, pmpD, CT610 and rS13.

The 12G3-83 clone also contains sequences to CT734 and CT764 in addition to CT622, and therefore these gene sequence may also have immunoreactive epitopes. Similarly, clone 21G12-60 contains sequences to the hypothetical protein genes CT229 and CT228 in addition to CT875; and 15H2-76 also contains sequences from CT812 and CT088, as well as sharing homology to the sycE gene. Clone 11H3-61 also contains sequences sharing homology to the PGP6-D virulence protein.

TABLE IV

| Clone | C.t. Antigen (putative*) | TCL from Asymp. Donors | TCL from C.t. Patients | SEQ ID NO: |
|---|---|---|---|---|
| 1B1-66 (E. coli) | Swib | 2/2 | 0/4 | 5 |
| 1B1-66 (protein) | Swib | 2/2 | 0/4 | 5 |
| 12G3-83 (E. coli) | CT622* | 2/2 | 4/4 | 57 |
| 22B3-53 (E. coli) | groEL | 1/2 | 4/4 | 111 |
| 22B3-53 (protein) | groEL | 1/2 | 4/4 | 111 |
| 15H2-76 (E. coli) | PmpD* | 1/2 | 3/4 | 87 |
| 11H3-61 (E. coli) | rL1* | 0/2 | 3/4 | 60 |
| 14H1-4 (E. coli) | TSA | 0/2 | 3/4 | 56 |
| 14H1-4 (protein) | TSA | 0/2 | 3/4 | 56 |
| 11G10-46 (E. coli) | CT610 | 1/2 | 1/4 | 62 |
| 10C10-17 (E. coli) | rS13 | 1/2 | 1/4 | 62 |
| 10C10-17 (protein) | rS13 | 1/2 | 1/4 | 62 |
| 21G12-60 (E. coli) | CT875* | 0/2 | 2/4 | 110 |
| 11H4-32 (E. coli) | dnaK | 0/2 | 2/4 | 59 |
| 21C7-8 (E. coli) | dnaK | 0/2 | 2/4 | 115 |
| 17C10-31 (E. coli) | CT858 | 0/2 | 2/4 | 114 |

Example 9

Protection Studies Using Chlamydia Antigens

1. SWIB

Protection studies were conducted in mice to determine whether immunization with chlamydial antigens can impact on the genital tract disease resulting from chlamydial inoculation. Two models were utilized; a model of intravaginal inoculation that uses a human isolate containing a strain of Chlamydia psittaci (MTW447), and a model of intrauterine inoculation that involves a human isolate identified as *Chlamydia trachomatis*, serovar F (strain NI1). Both strains induce inflammation in the upper genital tract, which resemble endometritis and salpingitis caused by *Chlamydia trachomatis* in women. In the first experiment, C3H mice (4 mice per group) were immunized three times with 100 μg of pcDNA-3 expression vector containing *C. trachomatis* SWIB DNA (SEQ ID NO: 1, with the corresponding amino acid sequence provided in SEQ ID NO: 5). Inoculations were at the base of the tail for systemic immunization. Two weeks after the last immunization, animals were progesterone treated and infected, either thru the vagina or by injection of the inoculum in the uterus. Two weeks after infection, the mice were sacrificed and genital tracts sectioned, stained and examined for histopathology. Inflammation level was scored (from + for very mild, to +++++ for very severe). Scores attributed to each single oviduct/ovary were summed and divided by the number of organs examined to get a mean score of inflammation for the group. In the model of uterine inoculation, negative control-immunized animals receiving empty vector showed consistent inflammation with an ovary/oviduct mean inflammation score of 6.12, in contrast to 2.62 for the DNA-immunized group. In the model of vaginal inoculation and ascending infection, negative control-immunized mice had an ovary/oviduct mean inflammation score of 8.37, versus 5.00 for the DNA-immunized group. Also, in the later model, vaccinated mice showed no signs of tubal occlusion while negative control vaccinated groups had inflammatory cells in the lumen of the oviduct In a second experiment, C3H mice (4 mice per group) were immunized three times with 50 μg of pcDNA-3 expression vector containing *C. trachomatis* SWIB DNA (SEQ ID NO: 1, with the corresponding amino acid sequence provided in SEQ ID NO: 5) encapsulated in Poly Lactide co-Glycolide microspheres (PLG); immunizations were made intra-peritoneally. Two weeks after the last immunization, animal were progesterone treated and infected by inoculation of *C. psittaci* in the vagina. Two weeks after infection, mice were sacrificed and genital tracts sectioned, stained and examined for histopathology. Inflammation level was scored as previously described. Scores attributed to each single oviduct/ovary were summed and divided by the number of examined organs to get a mean of inflammation for the group. Negative control-immunized animals receiving PLG-encapsulated empty vector showed consistent inflammation with an ovary/oviduct mean inflammation score of 7.28, versus 5.71 for the PLG-encapsulated DNA immunized group. Inflammation in the peritoneum was 1.75 for the vaccinated group versus 3.75 for the control.

In a third experiment, C3H mice (4 per group) were immunized three times with 10 μg of purified recombinant protein, either SWIB (SEQ ID NO: 1, with the corresponding amino acid sequence provided in SEQ ID NO: 5, or S13 (SEQ ID NO: 4, with the corresponding amino acid sequence provided in SEQ ID NO: 12) mixed with Cholera Toxin (CT); the preparation was administered intranasally upon anaesthesia in a 20 uL volume. Two weeks after the last immunization, animal were progesterone treated and infected, either by vaginal inoculation of *C. psittaci* or by injection of *C. trachomatis* serovar F in the uterus. Two weeks after infection, the mice were sacrificed and genital tracts sectioned, stained and examined for histopathology. The degree of inflammation was scored as described above. Scores attributed to each single oviduct/ovary were summed and divided by the number of examined organs to get a mean score of inflammation for the group. In the model of uterine inoculation, negative control-immunized animals receiving cholera toxin alone showed an ovary/oviduct mean inflammation score of 4.25 (only 2 mice analyzed; 2 other died) versus 5.00 for the s13 plus cholera toxin-immunized group, and 1.00 for the SWIB plus cholera toxin. Untreated infected animals had an ovary/oviduct mean inflammation score of 7. In the model of vaginal inoculation and ascending infection, negative control-immunized mice had an ovary/oviduct mean inflammation score of 7.37 versus 6.75 for the s13 plus cholera toxin-immunized group and 5.37 for the SWIB plus cholera toxin-immunized group. Untreated infected animals had an ovary/oviduct mean inflammation score of 8.

The three experiments described above suggest that SWIB-specific protection is obtainable. This protective effect is more marked in the model of homologous infection but is still present when in a heterologous challenge infection with *C. psittaci*.

2. CT529/Cap1

CT529/Cap1 was identified earlier as a product from *Chlamydia* that stimulates CD8+ CTL. In this example, we sought to confirm that immunization with Cap1 would be protective in an animal model of chlamydia infection.

To generate recombinant vaccinia virus for delivery of a Cap1 immunogenic fragment, a DNA fragment containing a modified Kozak sequence and base pairs 319-530 of the cap1 gene (CT529) was amplified from *C. trachomatis* L2 genomic DNA using PCR™ and ligated into pSC11ss (Earl P L, Koenig S, Moss B (1991) Biological and immunological properties of human immunodeficiency virus type 1 envelope glycoprotein: analysis of proteins with truncations and deletions expressed by recombinant vaccinia viruses. *J. Virol.* 65:31-41). DNA digested with SalI and StuI. The portion of the cap1 gene ligated into pSC11ss encodes amino acids 107-176 of Cap1 protein, containing the previously identified CTL epitope of amino acids 139-147. The resulting plasmid was used to transfect CV-1 cells (ATCC# CCL-70; Jensen F C et al. (1964) Infection of human and simian tissue cultures with Rous Sarcoma Virus. Proc. Natl. Acad. Sci. USA 52: 53-59.) which were subsequently infected with wild-type vaccinia virus. Homologous recombination between the wild-type virus and plasmid DNA generated recombinant vaccinia viruses which were selected on the basis of both beta-galactosidase expression and the inactivation of thymidine kinase, as described previously (Chakrabarti et al, Mol Cell Biol. 1985, 5(12):3403-9). Recombinant virus was plaque purified three times and titered after growth in human TK-143B cells. Virus preparations were treated with equal volume of 0.25 mg/ml trypsin for 30 mins. at 37° C. and diluted in PBS prior to immunization of mice. Groups of 5 mice were used for all experimental and control groups. The data presented below are representative of three independent experiments.

A group of mice was immunized with $10^6$ of the recombinant vaccinia i.p. and was allowed to recover for 3 weeks. Negative control groups were immunized with either buffer alone or wild-type vaccinia. As a positive control, a group of mice was infected i.v. with $10^6$ i.f.u. of *C. trachomatis*. The number of organisms given to the positive control group has been previously shown to be cleared within 2 weeks. After 3 weeks, animals in each of the groups were challenged i.v. with $10^6$ i.f.u. of *C. trachomatis*. Three days after challenge the mice were sacrificed and the number of i.f.u. per spleen was determined.

The mean number of organisms found in the spleens of animals immunized with the vaccinia virus expressing Cap1 ($7.1\times10^4$) was 2.6-fold fewer (p<0.01; Wilcoxon's-Rank Sum analysis) than animals in the control groups immunized with either buffer ($1.8\times10^5$) or wild-type vaccinia ($1.9\times10^5$). Animals in the positive group had 77-fold fewer organisms ($2.4\times103$) per spleen than animals in the negative control groups (p<0.01; Wilcoxon's-Rank Sum analysis). These data demonstrate that immunization with an immunogenic fragment of Cap1 can afford a statistically significant level of protection against *C. trachomatis* infection.

Example 10

Pmp/Ra12 Fusion Proteins

Various Pmp/Ra12 fusion constructs were generated by first synthesizing PCR fragments of a Pmp gene using primers containing a Not I restriction site. Each PCR fragment was then ligated into the NotI restriction site of pCRX1. The pCRX1 vector contains the 6HisRa12 portion of the fusion. The Ra12 portion of the fusion construct encodes a polypeptide corresponding to amino acid residues 192-323 of *Mycobacterium tuberculosis* MTB32A, as described in U.S. Patent Application 60/158,585, the disclosure of which is incorporated herein by reference. The correct orientation of each insert was determined by its restriction enzyme pattern and its sequence was verified. Multiple fusion constructs were made for PmpA, PmpB, PmpC, PmpF and PmpH, as described further below:

PmpA Fusion Proteins

PmpA is 107 kD protein containing 982 aa and was cloned from serovar E. The PmpA protein was divided into 2 overlapping fragments, the PmpA(N-terminal) and (C-terminal) portions.

PmpA(N-term) was amplified by the sense and antisense primers:

```
                                         (SEQ ID NO: 306)
    GAGAGCGGCCGCTCATGTTTATAACAAAGGAACTTATG (SEQ ID NO: 307)
    GAGAGCGGCCGCTTACTTAGGTGAGAAGAAGGGAGTTTC
``` respectively. The resulting fusion construct has a DNA sequence set forth in SEQ ID NO: 308, encoding a 66 kD protein (619aa) expressing the segment 1-473 aa of PmpA. The amino acid sequence of the fusion protein is set forth in SEQ ID NO: 309.

PmpA(C-term) was amplified by the sense and antisense primers:

```
                                         (SEQ ID NO: 310)
    GAGAGCGGCCGCTCCATTCTATTCATTTCTTTGATCCTG (SEQ ID NO: 311)
    GAGAGCGGCCGCTTAGAAGCCAACATAGCCTCC
``` respectively. The resulting fusion construct has a DNA sequence set forth in SEQ ID NO: 312, encoding a 74 kD protein (691aa) expressing the segment 438-982 aa of PmpA. The amino acid sequence of the fusion protein is set forth in SEQ ID NO: 313.

PmpF Fusion Proteins

PmpF is 112 kD protein containing 1034 aa and was cloned from the serovar E. PmpF protein was divided into 2 overlapping fragments, the PmpF(N-term) and (C-term) portions.

PmpF(N-term) was amplified by the sense and antisense primers:

```
                                         (SEQ ID NO: 314)
    GAGAGCGGCCGCTCATGATTAAAAGAACTTCTCTATCC (SEQ ID NO: 315)
    GAGAGCGGCCGCTTATAATTCTGCATCATCTTCTATGGC
``` respectively. The resulting fusion has a DNA sequence set forth in SEQ ID NO: 316, encoding a 69 kD protein (646aa) expressing the segment 1-499 aa of PmpF. The amino acid sequence of the fusion protein is set forth in SEQ ID NO: 317.

PmpF(C-term) was amplified by the sense and antisense primers:

```
                                    (SEQ ID NO: 318)
   GAGAGCGGCCGCTCGACATACGAACTCTGATGGG (SEQ ID NO: 319)
   GAGAGCGGCCGCTTAAAAGACCAGAGCTCCTCC
``` respectively. The resulting fusion has a DNA sequence set forth in SEQ ID NO: 320, encoding a 77 kD protein (715aa) expressing the segment 466-1034aa of PmpF. The amino acid sequence of the fusion protein is set forth in SEQ ID NO: 321.

PmpH Fusion Proteins

PmpH is 108 kD protein containing 1016 aa and was cloned from the serovar E. PmpH protein was divided into 2 overlapping fragments, the PmpH(N-term) and (C-term) portions.

PmpH(N-term) was amplified by the sense and antisense primers:

```
                                    (SEQ ID NO: 322)
   GAGAGCGGCCGCTCATGCCTTTTTCTTTGAGATCTAC (SEQ ID NO: 323)
   GAGAGCGGCCGCTTACACAGATCCATTACCGGACTG
``` respectively. The resulting fusion has a DNA sequence set forth in SEQ ID NO: 324, encoding a 64 kD protein (631 aa) expressing the segment 1-484 aa of PmpH. The amino acid sequence of the fusion protein is set forth in SEQ ID NO: 325. The donor line CHH037 was found to be reactive against this protein.

PmpH(C-term) was amplified by the sense and antisense primers:

```
                                    (SEQ ID NO: 326)
   GAGAGCGGCCGCTCGATCCTGTAGTACAAAATAATTCAGC (SEQ ID NO: 327)
   GAGAGCGGCCGCTTAAAAGATTCTATTCAAGCC
``` respectively. The resulting fusion construct has a DNA sequence set forth in SEQ ID NO: 328, encoding a 77 kD protein (715aa) expressing the segment 449-1016aa of PmpH. The amino acid sequence of the fusion protein is set forth in SEQ ID NO: 329. The patient line CT12 was found to be reactive in response to this protein.

PmpB Fusion Proteins

PmpB is 183 kD protein containing 1750 aa and was cloned from the serovar E. PmpB protein was divided into 4 overlapping fragments, PmpB(1), (2), (3) and (4).

PmpB(1) was amplified by the sense and antisense primers:

```
                                    (SEQ ID NO: 330)
   GAGAGCGGCCGCTCATGAAATGGCTGTCAGCTACTGCG (SEQ ID NO: 331)
   GAGAGCGGCCGCTTACTTAATGCGAATTTCTTCAAG
``` respectively. The resulting fusion has a DNA sequence set forth in SEQ ID NO: 332, and encodes is a 53 kD protein (518aa) expressing the segment 1-372 aa of PmpB. The amino acid sequence of the fusion protein is set forth in SEQ ID NO: 333.

PmpB(2) was amplified by the sense and antisense primers:

```
                                    (SEQ ID NO: 334)
   GAGAGCGGCCGCTCGGTGACCTCTCAATTCAATCTTC (SEQ ID NO: 335)
   GAGAGCGGCCGCTTAGTTCTCTGTTACAGATAAGGAGAC
``` respectively. The resulting fusion has a DNA sequence set forth in SEQ ID NO: 336 and encodes a 60 kD protein (585aa) expressing the segment 330-767 aa of PmpB. The amino acid sequence of the fusion protein is set forth in SEQ ID NO: 337. Cell lines derived from patient lines CT1, CT3, CT4 responded to this recombinant pmpB protein.

PmpB(3) was amplified by the sense and antisense primers:

```
                                    (SEQ ID NO: 338)
   GAGAGCGGCCGCTCGACCAACTGAATATCTCTGAGAAC (SEQ ID NO: 339)
   GAGCGGCCGCTTAAGAGACTACGTGGAGTTCTG
``` respectively. The resulting fusion has a DNA sequence set forth in SEQ ID NO: 340 encodes a 67 kD protein (654aa) expressing the segment 732-1236 aa of PmpB. The amino acid sequence of the fusion protein is set forth in SEQ ID NO: 341

PmpB(4) was amplified by the sense and antisense primers:

```
                                    (SEQ ID NO: 342)
   GAGAGCGGCCGCTCGGAACTATTGTGTTCTCTTCTG (SEQ ID NO: 343)
   GAGAGCGGCCGCTTAGAAGATCATGCGAGCACCGC
``` respectively. The resulting fusion construct has a DNA sequence set forth in SEQ ID NO: 344 encodes a 76 kD protein (700aa) expressing the segment 1160-1750 of PmpB. The amino acid sequence of the fusion protein is set forth in SEQ ID NO: 345.

PmpC Fusion Proteins

PmpC is 187 kD protein containing 1774 aa and was cloned from the serovar E/L2. PmpC protein was divided into 3 overlapping fragments, PmpC(1), (2) and (3).

PmpC(1) was amplified by the sense and antisense primers:

```
                                    (SEQ ID NO: 346)
   GAGAGCGGCCGCTCATGAAATTTATGTCAGCTACTGC (SEQ ID NO: 347)
   GAGAGCGGCCGCTTACCCTGTAATTCCAGTGATGGTC
``` respectively. The resulting fusion construct has a DNA sequence set forth in SEQ ID NO: 348 and encodes a 51 kD protein (487aa) expressing the segment 1-340 aa of PmpC. The amino acid sequence of the fusion protein is set forth in SEQ ID NO: 349.

PmpC(2) was amplified by the sense and antisense primers:

```
                                          (SEQ ID NO: 350)
GAGAGCGGCCGCTCGATACACAAGTATCAGAATCACC (SEQ ID NO: 351)
GAGAGCGGCCGCTTAAGAGGACGATGAGACACTCTCG
``` respectively. The resulting fusion construct has a DNA sequence set forth in SEQ ID NO: 352 and encodes a 60 kD protein (583aa) expressing the segment 305-741 aa of PmpC. The amino acid sequence of the fusion protein is set forth in SEQ ID NO: 353.

PmpC(3) was amplified by the sense and antisense primers:

```
                                          (SEQ ID NO: 354)
GAGAGCGGCCGCTCGATCAATCTAACGAAAACACAGACG (SEQ ID NO: 355)
GAGAGCGGCCGCTTAGACCAAAGCTCCATCAGCAAC
``` respectively. The resulting fusion construct has a DNA sequence set forth in SEQ ID NO: 356 and encodes a 70 kD protein (683aa) expressing the segment 714-1250 aa of PmpC. The amino acid sequence of the fusion protein is set forth in SEQ ID NO: 357.

Example 11

Immunogenicity of CT622

*Chlamydia*-specific T cells lines were generated from two patients with *Chlamydia* infections and the lines were designated CT1 and CT13. The T cell lines were either generated against monocyte-derived dendritic cells infected *C. trachomatis* serovar E for 72 hours (CT1-ERB) or against killed serovar E elementary bodies (EB) (CT13-EEB). Once generated, the lines were tested against the recombinant *Chlamydia*-specific protein, CT622 in a proliferation assay. Proliferation assays were performed by stimulating $2.5 \times 10^4$ T cells in the presence of $1 \times 10^4$ monocyte-derived dendritic cells with either recombinant CT antigens (2 µg/ml) or *Chlamydia* EBs (1 µg/ml). The assay was incubated for 4 days with a $^3$H-thymidine pulse for the last 18 hours.

Figure 12:
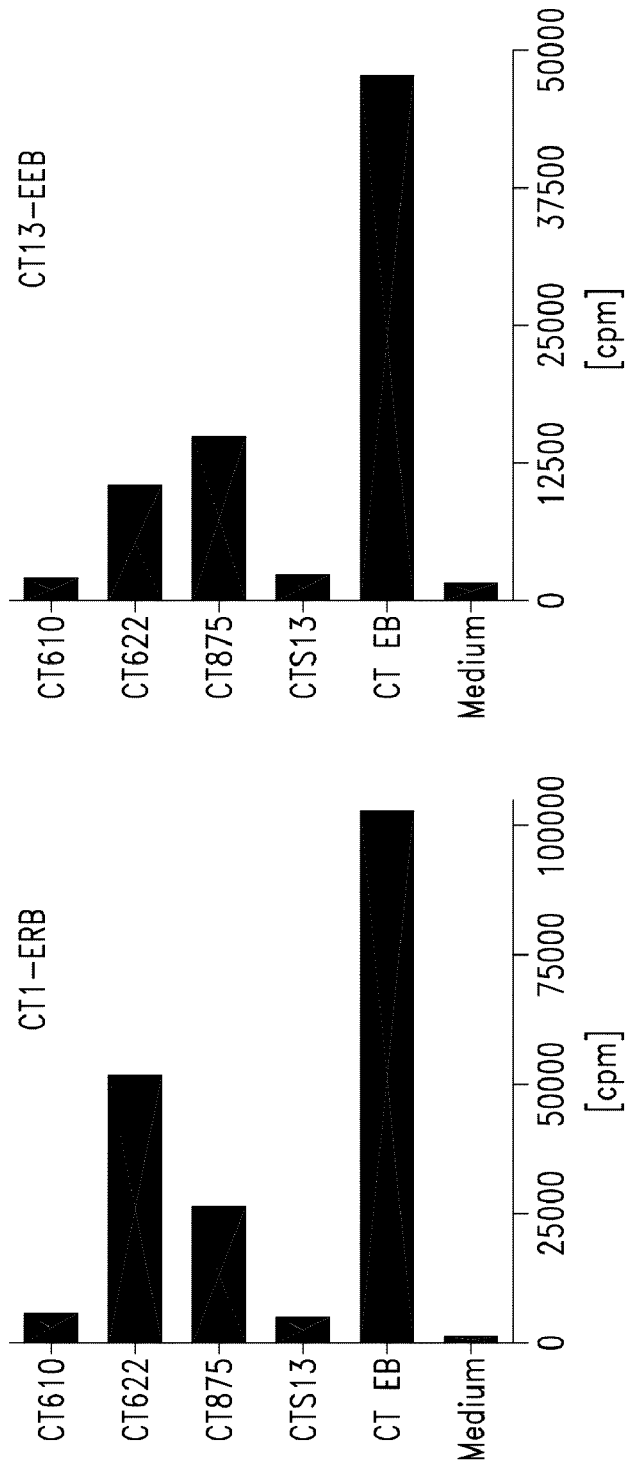
FIG. 12 shows the proliferative responses of T-cell lines CT1-ERB and CT13-EEB following stimulation with CT622, CT875, and CT EB.

The cell line CT1-ERB demonstrated proliferative responses significantly above the media controls when stimulated with CT622, CT875, and CT EB. The cell line CT13-EEB demonstrated a proliferative response significantly above media controls when stimulated with CT622, CT875, and CT EB (see FIG. 12).

Example 12

Cloning and Expression of Full Length *Chlamydia Trachomatis* Genes CT611, ORF3 and OppA1

Recombinant protein expression of the full-length open reading frames was performed for clones containing genes CT611, ORF-3, and oppA1. The clones that contained the genes of interest were CtL2-8 (SEQ ID NO:285) which encoded 4 ORFs (CT474, CT473, CT060, and CT139), CtL2-10 (SEQ ID NO:284) which encoded the ORFs of CT610 and CT611, and clones 16CtL2-16 (SEQ ID NO:47), 16-D4-22 (SEQ ID NO:119) and 19-A5-54 (SEQ ID NO:84) which all contained sequences related to ORF-3. Sequences within CtL2-10 (Ct-610) and CtL2-16 (ORF-3) were also independently identified by the T-cell expression cloning approach.

The clone CtL2-8 was further investigated as this clone had stimulated the proliferative responses and IFN-gamma production by two T cell lines generated against serovar E.

Cloning and Expression of Clone Sequences:

CtL2-10 was found to encode two open reading frames (ORFs), CT610 and CT611, and these were found organized adjacent to each other within the genomic clone. The full length ORF of CT610 (containing a PQQ synthesis domain) was previously expressed and demonstrated to stimulate the proliferative responses of T cell lines generated against *Chlamydia*. To determine whether the second ORF, CT611, was also recognized by T cells, the full-length sequence of CT611 was PCR amplified and engineered for protein expression. The nucleotide sequence is disclosed in SEQ ID NO:361 with the corresponding amino acid sequence disclosed in SEQ ID NO:365.

The second serological clone, CtL2-8, was found to contain 4 ORFs (CT474, CT473, CT060, and CT139). Overlapping peptides to the three smallest predicted ORFs (CT474, CT473, and CT060) did not stimulate the proliferative responses of T cell lines. This suggested that the immunostimulatory antigen resides in the fourth ORF, CT139. The ORF of CT139 is approximately 450 nucleotides. The full-length nucleotide sequence is disclosed in SEQ ID NO:359 and the full-length amino acid sequence is disclosed in SEQ ID NO:363. Amino acid sequence comparison from Genbank revealed that it is an oligo-peptide binding protein (oppA1) as well as belonging to the peptide ABC transporter family. This protein is 462 amino acids long with a predicted size of 48.3 kDa and appears to contain 2 trans-membrane regions.

To express the full-length sequence of oppA1, oligonucleotides were designed which specifically amplified sequences starting from amino acid residue 22 (devoid of the first trans-membrane domain), the nucleotide sequence for which is disclosed in SEQ ID NO:358 and, the amino acid sequence of which is disclosed in SEQ ID NO:362. This was shown to express the protein in *E. coli*.

The full-length cloning and recombinant protein expression of ORF-3 was also achieved. The nucleotide and amino acid sequences are disclosed in SEQ ID NOs:360 and 364, respectively.

Example 13

Recombinant Chlamydial Antigens Recognized by T Cell Lines

Patient T cell lines were generated from the following donors: CT1, CT2, CT3, CT4, CT5, CT6, CT7, CT8, CT9, CT10, CT11, CT12, CT13, CT14, CT15, and CT16, some of which were discussed above. A summary of their details is included in Table V.

TABLE V

| | | | *C. trachomatis* patients | | | |
|---|---|---|---|---|---|---|
| Patients | Gender | Age | Clinical Manifestation | Serovar | IgG titer | Multiple Infections |
| CT1 | M | 27 | NGU | LCR | Negative | No |
| CT2 | M | 24 | NGU | D | Negative | E |
| CT3 | M | 43 | Asymptomatic Shed Eb Dx was HPV | J | Ct 1:512 Cp 1:1024 Cps 1:256 | No |
| CT4 | F | 25 | Asymptomatic Shed Eb | J | Ct 1:1024 | Y |

TABLE V-continued

C. trachomatis patients

| Patients | Gender | Age | Clinical Manifestation | Serovar | IgG titer | Multiple Infections |
|---|---|---|---|---|---|---|
| CT5 | F | 27 | BV | LCR | Ct 1:256 Cp 1:256 | F/F |
| CT6 | M | 26 | Perinial rash Discharge, dysuria | G | Cp 1:1024 | N |
| CT7 | F | 29 | BV Genital ulcer | E | Ct 1:512 Cp 1:1024 | N |
| CT8 | F | 24 | Not Known | LCR | Not tested | NA |
| CT9 | M | 24 | asymptomatic | LCR | Ct 1:128 Cp 1:128 | N |
| CT10 | F | 20 | Mild itch vulvar | negative | negative | Dec. 1, 1998 |
| CT11 | F | 21 | BV Abnormal pap smear | J | Ct 1:512 | F/F/J/E/E PID June 1996 |
| CT12 | M | 20 | asymptomatic | LCR | Cp 1:512 | N |
| CT13 | F | 18 | BV, gonorrhea, Ct vaginal discharge, dysuria | G | Ct 1:1024 | N |
| CT14 | M | 24 | NGU | LCR | Ct 1:256 Cp 1:256 | N |
| CT15 | F | 21 | Muco-purulint cervicitis Vaginal discharge | culture | Ct 1:256 Ct IgM 1:320 Cp 1:64 | N |
| CT16 | M | 26 | Asymptomatic/contact | LCR | NA | N |
| CL8 | M | 38 | No clinical history of disease | negative | negative | N |

NGU = Non-Gonococcal Urethritis; BV = Bacterial Vaginosis; CT = *Chlamydia trachomatis*; Cp = *Chlamydia pneumoniae*; Eb = *Chlamydia* elementary bodies; HPV = human papiloma virus; Dx = diagnosis; PID = pelvic inflammatory disease; LCR = Ligase chain reaction.

PBMC were collected from a second series of donors and T cell lines have been generated from a sub-set of these. A summary of the details for three such T cell lines is listed in the table below.

TABLE VI

Normal Donors

| Donor | Gender | Age | CT IgG Titer | CP IgG Titer |
|---|---|---|---|---|
| CHH011 | F | 49 | 1:64 | 1:16 |
| CHH037 | F | 22 | 0 | 0 |
| CHH042 | F | 25 | 0 | 1:16 |

Donor CHH011 is a healthy 49 year old female donor sero-negaitve for *C. trachomatis*. PBMC produced higher quantities of IFN-gamma in response to *C. trachomatis* elementary bodies as compared to *C. pneumoniae* elementary bodies, indicating a *C. trachomatis*-specific response. Donor CHH037 is a 22 year old healthy female donor sero-negative for *C. trachomatis*. PBMC produced higher quantities of IFN-gamma in response to *C. trachomatis* elementary bodies as compared to *C. pneumoniae* elementary bodies, indicating a *C. trachomatis*-specific response. CHH042 is a 25 year old healthy female donor with an IgG titer of 1:16 to *C. pneumoniae*. PBMC produced higher quantities of IFN-gamma in response to *C. trachomatis* elementary bodies as compared to *C. pneumoniae* elementary bodies, indicating a *C. trachomatis*-specific response.

Recombinant proteins for several *Chlamydia trachomatis* genes were generated as described above. Sequences for MOMP was derived from serovar F. The genes CT875, CT622, pmp-B-2, pmpA, and CT529 were derived from serovar E and sequences for the genes gro-EL, Swib, pmpD, pmpG, TSA, CT610, pmpC, pmpE, S13, lpdA, pmpI, and pmpH-C were derived from LII.

Several of the patient and donor lines described above were tested against the recombinant *Chlamydia* proteins. Table IV summarizes the results of the T cell responses to these recombinant *Chlamydia* proteins.

TABLE VII

Recombinant Chlamydia Antigens Recognized By T Cell Lines

| Antigen | Serovar | #of hits | CL8 L2 | CT10 E | CT1 E | CT3 E | CT4 L2 | CT5 E | CT11 E | CT12 E | CT13 E | CHH-011 E | CHH-037 E |
|---|---|---|---|---|---|---|---|---|---|---|---|---|---|
| gro-EL (CT110) | L2 | 10 | − | + | + | + | + | + | + | + | + | + | + |
| MompF (CT681) | F | 10 | − | + | + | + | + | + | + | + | + | + | + |
| CT875 | E | 8 | − | + | + | − | + | + | + | + | + | − | + |
| SWIB(CT460) | L2 | 8 | + | + | − | + | − | + | − | + | + | + | + |
| pmpD (CT812) | L2 | 5 | − | + | + | + | + | − | − | + | + | − | − |
| pmpG (CT871) | L2 | 6 | − | + | + | − | + | + | nt | − | + | + | − |
| TSA (CT603) | L2 | 6 | − | − | + | + | + | + | − | − | + | − | + |
| CT622 | E | 3 | − | − | + | − | + | − | − | − | + | − | − |
| CT610 | L2 | 3 | − | + | − | + | − | − | − | + | − | − | − |
| pmpB-2 (CT413) | E | 3 | − | − | + | + | + | − | − | − | − | − | − |
| pmpC (CT414) | L2 | 4 | − | − | − | + | − | + | − | + | − | − | + |
| pmpE (CT869) | L2 | 3 | − | + | + | − | − | − | − | − | + | − | − |
| S13 (CT509) | L2 | 2 | + | − | − | − | + | − | − | − | − | − | − |
| lpdA (CT557) | L2 | 3 | − | − | + | + | − | − | − | − | − | + | − |

TABLE VII-continued

Recombinant *Chlamydia* Antigens Recognized By T Cell Lines

| Antigen | Sero-var | #of hits | CL8 L2 | CT10 E | CT1 E | CT3 E | CT4 L2 | CT5 E | CT11 E | CT12 E | CT13 E | CHH-011 E | CHH-037 E |
|---|---|---|---|---|---|---|---|---|---|---|---|---|---|
| pmpI (CT874) | L2 | 2 | – | – | + | – | – | – | – | – | – | + | – |
| pmpH-C (CT872) | L2 | 1 | – | – | – | – | – | – | – | + | – | – | – |
| pmpA (CT412) | E | 0 | – | – | – | – | – | – | – | – | – | – | – |
| CT529 | E | 0 | – | – | – | – | – | – | – | – | – | – | – |

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (605 sequences)

SEQ ID NO: 1 - DNA, 481 bp, Chlamydia trachomatis
ctgaagacttggctatgttttttattttgacgataaacctagttaaggcataaaagagttgcgaaggaagagccctcaacttttcttatcaccttctttaactaggagtcatccatgagtcaaaataagaactctgctttcatgcagcctgtgaacgtatccgctgatttagctgccatcgttggtgcaggacctatgcctcgcacagagatcattaagaaaatgtgggattacattaaggagaatagtcttcaagatcctacaaacaaacgtaatatcaatcccgatgataaattggctaaagtttttggaactgaaaaacctatcgatatgttccaaatgacaaaaatggtttctcaacacatcattaaataaaatagaaattgactcacgtgttcctcgtctttaagatgaggaactagttcattctttttgttcgtttttgtgggtattactgtatctttaacaactatcttagcag

SEQ ID NO: 2 - DNA, 183 bp, Chlamydia trachomatis
atcgttggtgcaggacctatgcctcgcacagagatcattaagaaaatgtgggattacattaaggagaatagtcttcaagatcctacaaacaaacgtaatatcaatcccgatgataaattggctaaagtttttggaactgaaaaacctatcgatatgttccaaatgacaaaaatggtttctcaa

SEQ ID NO: 3 - DNA, 110 bp, Chlamydia trachomatis
gctgcgacatcatgcgagcttgcaaaccaacatggacatctccaatttccccttctaactcgctctttggaactaatgctgctaccgagtcaatcacaatcacatcgacc

SEQ ID NO: 4 - DNA, 555 bp, Chlamydia trachomatis
cggcacgagcctaagatgcttatactactttaagggaggcccttcgtatgccgcgcatcattggaatagatattcctgcgaaaaagaaattaaaaataagtcttacatatatttatggaatagggccagctctttctaaagagattattgctagattgcagttgaatcccgaagctagagctgcagagttgactgaggaagaggttggtcgactaaacgctcttttacagtcggattacgttgttgaaggggatttgcgccgtcgtgtgcaatctgatatcaaacgtctgattactatccatgcttatcgtggacaaagacatagactttctttgcctgttcgtggtcagagaacaaaaacaaattctcgcacgcgtaagggtaaacgtaaaactattgcaggtaagaagaaataataatttttaggagagagtgttttggttaaaaatcaagcgcaaaaaagaggcgtaaaaagaaaacaagtaaaaaacattccttcgggcgttgtccatgttaaggctacttttaataatacaattgtaaccataacagacc

SEQ ID NO: 5 - protein, 86 aa, Chlamydia trachomatis
MSQNKNSAFMQPVNVSADLAAIVGAGPMPRTEIIKKMWDYIKENSLQDPTNKRNINPDDKLAKVFGTEKPIDMFQMTKMVSQHIIK

SEQ ID NO: 6 - protein, 61 aa, Chlamydia trachomatis
IVGAGPMPRTEIIKKMWDYIKENSLQDPTNKRNINPDDKLAKVFGTEKPIDMFQMTKMVSQ

SEQ ID NO: 7 - protein, 36 aa, Chlamyida trachomatis
AATSCELANQHGHLQFPLLTRSLELMLLPSQSQSHR

SEQ ID NO: 8 - protein, 18 aa, Chlamydia trachomatis
LRHHASLQTNMDISNFPF

SEQ ID NO: 9 - protein, 5 aa, Chlamydia trachomatis
LALWN

SEQ ID NO: 10 - protein, 11 aa, Chlamydia trachomatis
CCYRVNHNHID

SEQ ID NO: 11 - protein, 36 aa, Chlamydia trachomatis
VDVIVIDSVAALVPKSELEGEIGDVHVGLQARMMSQ

SEQ ID NO: 12 - protein, 122 aa, Chlamydia trachomatis
MPRIIGIDIPAKKKLKISLTYIYGIGPALSKEIIARLQLNPEARAAELTEEEVGRLNALLQSDYVVEGDLRRRVQSDIKRLITIHAYRGQRHRLSLPVRGQRTKTNSRTRKGKRKTIAGKKK

SEQ ID NO: 13 - protein, 20 aa, Chlamydia trachomatis
DPTNKRNINPDDKLAKVFGT

SEQ ID NO: 14 - protein, 20 aa, Chlamydia trachomatis
DDKLAKVFGTEKPIDMFQMT

SEQ ID NO: 15 - DNA, 161 bp, Chlamydia trachomatis
atctttgtgtgtctcataagcgcagagcggctgcggctgtctgtagcttcatcggaggaattacctacctcgcgacattcggagctatccgtccgattctgtttgtcaacaaaatgctggcgcaaccgtttctttcttcccaaactaaagcaaatatggga

SEQ ID NO: 16 - DNA, 897 bp, Chlymidia trachomatis
atggcttctatatgcggacgtttagggtctggtacagggaatgctctaaaagctttttttacacagcccaacaataaaatggcaagggtagtaaataagacgaagggaatggataagactattaaggttgccaagtctgctgccgaattgaccgcaaatattttggaacaagctggaggcgcgggctcttccgcacacattacagcttcccaagtgtccaaaggattaggggatgcgagaactgttgtcgctttagggaatgcctttaacggagcgttgccaggaacagttcaaagtgcgcaaagcttcttctctcacatgaaagctgctagtcagaaaacgcaagaaggggatgaggggctcacagcagatctttgtgtgtctcataagcgcagagcggctgcggctgtctgtagcatcatcggaggaattacctacctcgcgacattcggagctatccgtccgattctgtttgtcaacaaaatgctggcaaaaccgtttctttcttcccaaactaaagcaaatatgggatcttctgttagctatattatggcggctaaccatgcagcgtctgtggtgggtgctggactcgctatcagtgcggaaagagcagattgcgaagcccgctgcgctcgtattgcgagagaagagtcgttactcgaagtgccgggagaggaaaatgcttgcgagaagaaagtcgctggagagaaagccaagacgttcacgcgcatcaagtatgcactcctcactatgctcgagaagtttttggaatgcgttgccgacgttttcaaattggtgccgctgcctattacaatgggtattcgtgcgattgtggctgctggatgtacgttcacttctgcaattattggattgtgcactttctgcgccagagcataa

SEQ ID NO: 17 - protein, 298 aa, Chlamydia trachomatis
MASICGRLGSGTGNALKAFFTQPNNKMARVVNKTKGMDKTIKVAKSAAELTANILEQAGGAGSSAHITASQVSKGLGDARTVVALGNAFNGALPGTVQSAQSFFSHMKAASQKTQEGDEGLTADLCVSHKRRAAAAVCSIIGGITYLATFGAIRPILFVNKMLAKPFLSSQTKANMGSSVSYIMAANHAASVVGAGLAISAERADCEARCARIAREESLLEVPGEENACEKKVAGEKAKTFTRIKYALLTMLEKFLECVADVFKLVPLPITMGIRAIVAAGCTFTSAIIGLCTFCARA

SEQ ID NO: 18 - protein, 18 aa, Chlamydia trachomatis
RAAAAAAVCSFIGGITYL

SEQ ID NO: 19 - protein, 18 aa, Chlamydia trachomatis
CSFIGGITYLATFGAIRP

SEQ ID NO: 20 - protein, 216 aa, Chlamydia trachomatis
MRGSQQIFVCLISAERLRLSVASSEELPTSRHSELSVRFCLSTKCWQNRFFLPKLKQIWDLLLAILWRLTMQRLWWVLDSLSVRKEQIAKPAALVLREKSRYSKCRERKMLARRKSLERKPRRSRASSMHSSLCSRSFWNALPTFSNWCRCLLQWVFVRLWLLDVRSLLQLLDCALSAPEHKGFFKFLKKKAVSKKKQPFLSTKCLAFLIVKIVFL

SEQ ID NO: 21 - DNA, 1256 bp, Chlamydia trachomatis
ctcgtgccggcacgagcaaagaaatccctcaaaaaatggccattattggcggtggtgtgatcggttgcgaattcgcttccttattccatacgttaggctccgaagtttctgtgatcgaagcaagctctcaaatccttgctttgaataatccagatatttcaaaaaccatgttcgataaattcacccgacaaggactccgtttcgtactagaagcctctgtatcaaatattgaggatataggagatcgcgttcggttaactatcaatgggaatgtcgaagaatacgattacgttctcgtatctataggacgccgtttgaatacagaaaatattggcttggataaagctggtgttatttgtgatgaacgcggagtcatccctaccgatgccacaatgcgcacaaacgtacctaacatttatgctattggagatatcacaggaaaatggcaacttgcccatgtagcttctcatcaaggaatcattgcagcacggaatataggtggccataaagaggaaatcgattactctgctgtcccttctgtgatctttaccttccctgaagtcgcttcagtaggcctctccccaacagcagctcaacaacatctccttcttcgcttactttttctgaaaaatttgatacagaagaagaattcctcgcacacttgcgaggaggagggcgtctggaagaccagttgaatttagctaagttttctgagcgttttgattctttgcgagaattatccgctaagcttggttacgatagcgatggagagactggggatttcttcaacgaggagtacgacgacgaagaagaggaaatcaaaccgaagaaaactacgaaacgtggacgtaagaagagccgttcataagccttgcttttaaggtttggtagttttacttctctaaaatccaaatggttgctgtgccaaaaagtagtttgcgtttccggatagggcgtaaatgcgctgcatgaaagattgcttcgagagcggcatcgcgtgggagatcccggatactttctttcagatacgaataagcatagctgttcccagaataaaaacggccgacgctaggaacaacaagatttagatagagcttgtgtagcaggtaaactgggttatatgttgctgggcgtgttagttctagaatacccaagtgtcctccaggttgtaatactcgatacacttccctaagagcctctaatggataggataagttccgtaatccataggccatagaagctaaacgaaacgtatt

SEQ ID NO: 22 - DNA, 601 bp, Chlamydia trachomatis
ctcgtgccggcacgagcaaagaaatccctcaaaaaatggccattattggcggtggtgtgatcggttgcgaattcgcttccttattccatacgttaggctccgaagtttctgtgatcgaagcaagctctcaaatccttgctttgaataatccagatatttcaaaaaccatgttcgataaattcacccgacaaggactccgtttcgtactagaagcctctgtatcaaatattgaggatataggagatcgcgttcggttaactatcaatgggaatgtcgaagaatacgattacgttctcgtatctataggacgccgtttgaatacagaaaatattggcttggataaagctggtgttatttgtgatgaacgcggagtcatccctaccgatgccacaatgcgcacaaacgtacctaacatttatgctattggagatatcacaggaaaatggcaacttgcccatgtagcttctcatcaaggaatcattgcagcacggaatataggtggccataaagaggaaatcgattactctgctgtcccttctgtgatctttaccttccctgaagtcgcttcagtaggcctctccccaacagcagctcaacaaca

SEQ ID NO: 23 - DNA, 270 bp, Chlamydia trachomatis
acatctccttcttcgcttactttttctgaaaaatttgatacagaagaagaattcctcgcacacttgcgaggaggagggcgtctggaagaccagttgaatttagctaagttttctgagcgttttgattctttgcgagaattatccgctaagcttggttacgatagcgatggagagactggggatttcttcaacgaggagtacgacgacgaagaagaggaaatcaaaccgaagaaaactacgaaacgtggacgtaagaagagccgttcataa

SEQ ID NO: 24 - DNA, 363 bp, Chlamydia trachomatis
ttacttctctaaaatccaaatggttgctgtgccaaaaagtagtttgcgtttccggatagggcgtaaatgcgctgcatgaaagattgcttcgagagcggcatcgcgtgggagatcccggatactttctttcagatacgaataagcatagctgttcccagaataaaaacggccgacgctaggaacaacaagatttagatagagcttgtgtagcaggtaaactgggttatatgttgctgggcgtgttagttctagaatacccaagtgtcctccaggttgtaatactcgatacacttccctaagagcctctaatggataggataagttccgtaatccataggccatagaagctaaacgaaacgtatt

SEQ ID NO: 25 - DNA, 696 bp, Chlamydia trachomatis
gctcgtgccggcacgagcaaagaaatccctcaaaaaatggccattattggcggtggtgtgatcggttgcgaattcgcttccttattccatacgttaggctccgaagtttctgtgatcgaagcaagctctcaaatccttgctttgaataatccagatatttcaaaaaccatgttcgataaattcacccgacaaggactccgtttcgtactagaagcctctgtatcaaatattgaggatataggagatcgcgttcggttaactatcaatgggaatgtcgaagaatacgattacgttctcgtatctataggacgccgtttgaatacagaaaatattggcttggataaagctggtgttatttgtgatgaacgcggagtcatccctaccgatgccacaatgcgcacaaacgtacctaacatttatgctattggagatatcacaggaaaatggcaacttgcccatgtagcttctcatcaaggaatcattgcagcacggaatataggtggccataaagaggaaatcgattactctgctgtcccttctgtgatctttaccttccctgaagtcgcttcagtaggcctctccccaacagcagctcaacaacatctccttcttcgcttactttttctgaaaaatttgatacagaagaagaattcctcgcacacttgcgaggaggagggcgtctggaagaccagttga

SEQ ID NO: 26 - protein, 231 aa, Chlamydia trachomatis
ARAGTSKEIPQKMAIIGGGVIGCEFASLFHTLGSEVSVIEASSQILALNNPDISKTMFDKFTRQGLRFVLEASVSNIEDIGDRVRLTINGNVEEYDYVLVSIGRRLNTENIGLDKAGVICDERGVIPTDATMRTNVPNIYAIGDITGKWQLAHVASHQGIIAARNIGGHKEEIDYSAVPSVIFTFPEVASVGLSPTAAQQHLLLRLLFLKNLIQKKNSSHTCEEEGVWKTS

SEQ ID NO: 27 - DNA, 264 bp, Chlamydia pneumoniae
atgagtcaaaaaaataaaaactctgcttttatgcatcccgtgaatatttccacagatttagcagttatagttggcaagggacctatgcccagaaccgaaattgtaaagaaagtttgggaatacattaaaaaacacaactgtcaggatcaaaaaaataaacgtaatatccttcccgatgcgaatcttgccaaagtctttggctctagtgatcctatcgacatgttccaaatgaccaaagccctttccaaacatattgtaaaataa

SEQ ID NO: 28 - protein, 87 aa, Chlamydia pneumoniae
MSQKNKNSAFMHPVNISTDLAVIVGKGPMPRTEIVKKVWEYIKKHNCQDQKNKRNILPDANLAKVFGSSDPIDMFQMTKALSKHIVK

SEQ ID NO: 29 - DNA, 369 bp, Chlamydia pneumoniae
atgccacgcatcattggaattgatattcctgcaaagaaaaagttaaaaataagtctgacatatatttatggaataggatcagctcgttctgatgaaatcattaaaaagttgaagttagatcctgaggcaagagcctctgaattaactgaagaagaagtaggacgactgaactctctgctacaatcagaatataccgtagaaggggatttgcgacgtcgtgttcaatcggatatcaaaagattgatcgccatccattcttatcgaggtcagagacatagactttctttaccagtaagaggacaacgtacaaaaactaattctcgtactcgaaaaggtaaaagaaaaacagtcgcaggtaagaagaaataa

SEQ ID NO: 30 - protein, 122 aa, Chlamydia pneumoniae
MPRIIGIDIPAKKKLKISLTYIYGIGSARSDEIIKKLKLDPEARASELTEEEVGRLNSLLQSEYTVEGDLRRRVQSDIKRLIAIHSYRGQRHRLSLPVRGQRTKTNSRTRKGKRKTVAGKKK

SEQ ID NO: 31 - protein, 10 aa, Artificial Sequence
  Made in the lab
CSFIGGITYL

SEQ ID NO: 32 - protein, 53 aa, Chlamydia trachomatis
LCVSHKRRAAAAVCSFIGGITYLATFGAIRPILFVNKMLAQPFLSSQTKANMG

SEQ ID NO: 33 - DNA, 161 bp, Chlamydia trachomatis
atctttgtgtgtctcataagcgcagagcggctgcggctgtctgtagcatcatcggaggaattacctacctcgcgacattcggagctatccgtccgattctgtttgtcaacaaaatgctggcaaaaccgtttctttcttcccaaactaaagcaaatatggga

SEQ ID NO: 34 - protein, 53 aa, Chlamydia trachomatis
LCVSHKRRAAAAVCSIIGGITYLATFGAIRPILFVNKMLAKPFLSSQTKANMG

SEQ ID NO: 35 - DNA, 55 bp, Chlamydia pneumoniae
gatatacatatgcatcaccatcaccatcacatgagtcaaaaaaaataaaaactct

SEQ ID NO: 36 - DNA, 33 bp, Chlamydia pneumoniae
ctcgaggaattcttattttacaatatgtttgga

SEQ ID NO: 37 - DNA, 53 bp, Chlamydia pneumoniae
gatatacatatgcatcaccatcaccatcacatgccacgcatcattggaatgat

SEQ ID NO: 38 - DNA, 30 bp, Chlamydia pneumoniae
ctcgaggaattcttatttcttcttacctgc

SEQ ID NO: 39 - protein, 16 aa, Artificial Sequence
  Made in the lab
KRNINPDDKLAKVFGT

SEQ ID NO: 40 - protein, 16 aa, Artificial Sequence
  made in the lab
KRNILPDANLAKVFGS

SEQ ID NO: 41 - protein, 15 aa, Artificial Sequence
  made in the lab
KEYINGDKYFQQIFD

SEQ ID NO: 42 - protein, 16 aa, Artificial Sequence
  made in the lab
KKIIIPDSKLQGVIGA

SEQ ID NO: 43 - protein, 15 aa, Artificial Sequence
  made in the lab
KKLLVPDNNLATIIG

SEQ ID NO: 44 - DNA, 509 bp, Chlamydia
ggagctcgaattcggcacgagagtgcctattgttttgcaggctttgtctgatgatagcgataccgtacgtgagattgctgtacaagtagctgttatgtatggttctagttgcttactgcgcgccgtgggcgatttagcgaaaaatgattcttctattcaagtacgcatcactgcttatcgtgctgcagccgtgttggagatacaagatcttgtgcctcatttacgagttgtagtccaaaatacacaattagatggaacggaaagaagagaagcttggagatctttatgtgttcttactcggcctcatagtggtgtattaactggcatagatcaagctttaatgacctgtgagatgttaaaggaatatcctgaaaagtgtacggaagaacagattcgtacattattggctgcagatcatccagaagtgcaggtagctactttacagatcattctgagaggaggtagagtattccggtcatcttctataatggaatcggttctcgtgccgg

SEQ ID NO: 45 - DNA, 481 bp, Chlamydia
  unsure (23): n=A,T,C or G
gatccgaattcggcacgaggcantatttactcccaacattacggttccaaataagcgataaggtcttctaataaggaagttaatgtaagaggcttttttattgcttttcgtaaggtagtattgcaaccgcacgcgattgaatgatacgcaagccatttccatcatggaaaagaacccttggacaaaaatacaaaggaggttcactcctaaccagaaaaagggagagttagtttccatgggttttccttatatacacccgtttcacacaattaggagccgcgtctagtatttggaatacaaattgtccccaagcgaattttgttcctgtttcagggatttctcctaattgttctgtcagccatccgcctatggtaacgcaattagctgtagtaggaagatcaactccaaacaggtcatagaaatcagaaagctcataggtgcctgcagcaataacaacattcttgtctgagtgagcgaattg

SEQ ID NO: 46 - DNA, 427 bp, Chlamydia
  unsure (20): n=A,T,C or G
gatccgaattcggcacgagntttttcctgttttttcttagtttttagtgttcccggagcaataacacagatcaaagaacggccattcagtttaggctctgactcaacaaaacctatgtcctctaagccctgacacattctttgaacaaccttatgcccgtgttcgggataagccaactctcgcccccgaaacatacaagaaacctttactttatttcctttctcaataaaggctctagcttgctttgctttcgtaagaaagtcgttatcatcgatattaggcttaagcttaacctctttgatacgcacttggtgctgtgctttcttactatctttttcttttttagttatgtcgtaacgatacttcccgtagtccatgattttgcacacaggaggctctgagtttgaagcaacctcgtgccgaattc

SEQ ID NO: 47 - DNA, 600 bp, Chlamydia
  unsure (522): n=A,T,C or G
gatccgaattcggcacgagatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggngtggtatgggttaatgccctttctaatggcaatgatattttaggaataacaaatcttctaatgtatcttttttggagg

SEQ ID NO: 48 - DNA, 600 bp, Chlamydia
ggagctcgaattcggcacgagctctatgaatatccaattctctaaactgttcggataaaaatgatgcaggaattaggtccacactatctttttttgtttcgcaaatgattgattttaaatcgtttgatgtgtatactatgtcgtgtaagcctttttggttacttctgacactagcccccaatccagaagataaattggattgcgggtctaggtcagcaagtaacacttttttccctaaaaattgggccaagttgcatcccacgtttagagaaagtgttgtttttccagttcctcccttaaaagagcaaaaaactaaggtgtgcaaatcaactccaacgttagagtaagttatctattcagccttggaaaacatgtcttttctagacaagataagcataatcaaagccttttttagctttaaactgttatcctctaatttttcaagaacaggagagtctgggaataatcctaaagagttttctatttgttgaagcagtcctagaattagtgagacacttttatggtagagttctaagggagaatttaagaaagttactttttccttgtttactcgtatttttaggtctaattcggggaaat

SEQ ID NO: 49 - DNA, 600 bp, Chlamydia
gatccgaattcggcacgagatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggag

SEQ ID NO: 50 - DNA, 406 bp, Chlamydia
gatccgaattcggcacgagttcttagcttgcttaattacgtaattaaccaaactaaaggggctatcaaatagcttattcagtctttcattagttaaacgatcttttctagccatgactcatcctatgttcttcagctataaaaatacttcttaaaacttgatatgctgtaatcaaatcatcattaaccacaacataatcaaattcgctagcggcagcaatttcgacagcgctatgctctaatctttctttcttctggaaatctttctctgaatcccgagcattcaaacggcgctcaagttcttcttgagagggagcttgaataaaaatgtgactgccggcatttgcttcttcagagccaaagctccttgtacatcaatcacggctatgcagtctcgtgccgaattc

SEQ ID NO: 51 - DNA, 602 bp, Chlamydia
gatccgaattcggcacgagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaaaagttcgaattacggggtttgttatgcaaaataaactcgtgccgaattc

SEQ ID NO: 52 - DNA, 145 bp, Chlamydia
gatccgaattcggcacgagctcgtgccgatgtgttcaacagcatccataggatgggcagtcaaatatactccaagtaattctttttctcttttcaacaactccttaggagagcgttggataacattttcagctcgtgccgaattc

SEQ ID NO: 53 - DNA, 450 bp, Chlamydia
gatccgaattcggcacgaggtaatcggcaccgcactgctgacactcatctcctcgagctcgatcaaacccacacttgggacaagtacctacaacataacggtccgctaaaaacttcccttcttcctcagaatacagctgttcggtcacctgattctctaccagtccgcgttcctgcaagtttcgatagaaatcttgcacaatagcaggatgataagcgttcgtagttctggaaaagaaatctacagaaattcccaatttcttgaaggtatctttatgaagcttatgatacatgtcgacatattcttgataccccatgcctgccaactctgcattaagggtaattgcgattccgtattcatcagaaccacaaatatacaaaacctctttgccttgtagtctctgaaaacgcgcataaacatctgcaggcaaataagcctcgtgccgaattc

SEQ ID NO: 54 - DNA, 716 bp, Chlamydia
gatcgaaattcggcacgagcggcacgagttttctgatagcgatttacaatcctttattcaacttttgcctagagaggcacactatactaagaagtttcttgggtgtgtggcacagtcctgtcgtcaggggattctgctagaggggtaggggaaaaaacccttattactatgaccatgcgcatgtggaattacattccatagactttcgcatcattcccaacatttacacagctctacacctcttaagaagaggtgacgtggattgggtggggcagccttggcaccaagggattccttttgagcttcggactacctctgctctctacacccattaccctgtagatggcacattctggcttattcttaatcccaaagatcctgtactttcctctctatctaatcgtcagcgattgattgctgccatccaaaaggaaaaactggtgaagcaagctttaggaacacaatatcgagtagctgaaagctctccatctccagagggaatcatagctcatcaagaagcttctactccttttcctgggaaaattactttgatatatcccaataatattacgcgctgtcagcgtttggccgaggtatccaaaaaatgatcgacaaggagcacgctaaatttgtacataccccaaaatcaatcagccatctaggcaaatggaatatcaaagtaaacagtatacaactggggatctcgtgccgaattc

SEQ ID NO: 55 - DNA, 463 bp, Chlamydia trachomatis
tctcaaatccttgctttgaataatccagatatttcaaaaaccatgttcgataaattcacccgacaaggactccgtttcgtactagaagcctctgtatcaaatattgaggatataggagatcgcgttcggttaactatcaatgggaatgtcgaagaatacgattacgttctcgtatctataggacgccgtttgaatacagaaaatattggcttggataaagctggtgttatttgtgatgaacgcggagtcatccctaccgatgccacaatgcgcacaaacgtacctaacatttatgctattggagatatcacaggaaaatggcaacttgcccatgtagcttctcatcaaggaatcattgcagcacggaatataggtggccataaagaggaaatcgattactctgctgtcccttctgtgatctttaccttccctgaagtcgcttcagtaggcctctccccaacag

SEQ ID NO: 56 - DNA, 829 bp, Chlamydia trachomatis
gtactatgggatcattagttggaagacaggctccggatttttctggtaaagccgttgtttgtggagaagagaaagaaatctctctagcagactttcgtggtaagtatgtagtgctcttcttttatcctaaagattttacctatgtttgtcctacagaattacatgcttttcaagatagattggtagattttgaagagcatggtgcagtcgtccttggttgctccgttgacgacattgagacacattctcgttggctcactgtagcgagagatgcaggagggatagagggaacagaatatcctctgttagcagacccctcttttaaaatatcagaagcttttggtgttttgaatcctgaaggatcgctcgctttaagagctactttccttatcgataaacatggggttattcgtcatgcggttatcaatgatcttcctttagggcgttccattgacgaggaattgcgtattttagattcattgatcttctttgagaaccacggaatggtttgtccagctaactggcgttctggagagcgtggaatggtgccttctgaagagggattaaaagaatacttccagacgatggattaagcatctttgaaagtaagaaagtcgtacagatcttgatctgaaaagagaagaaggctttttaattttctgcagagagccagcgaggcttcaataatgttgaagtctccgacaccaggcaatgctaaggcgacgatattagttagtgaagtctgagtattaaggaaatgaaggccaaagaaatagctatcaataaagaagccttcttccttgactctaaagaatagtatgtcgtatcc

SEQ ID NO: 57 - DNA, 1537 bp, Chlamydia trachomatis
acatcaagaaatagcggactcgcctttagtgaaaaaagctgaggagcagattaatcaagcacaacaagatattcaaacgatcacacctagtggtttggatattcctatcgttggtccgagtgggtcagctgcttccgcaggaagtgcggcaggagcgttgaaatcctctaacaattcaggaagaatttccttgttgcttgatgatgtagacaatgaaatggcagcgattgcaatgcaaggttttcgatctatgatcgaacaatttaatgtaaacaatcctgcaacagctaaagagctacaagctatggaggctcagctgactgcgatgtcagatcaactggttggtgcggatggcgagctcccagccgaaatacaagcaatcaaagatgctcttgcgcaagctttgaaacaaccatcagcagatggtttagctacagctatgggacaagtggcttttgcagctgccaaggttggaggaggctccgcaggaacagctggcactgtccagatgaatgtaaaacagctttacaagacagcgttttcttcgacttcttccagctcttatgcagcagcactttccgatggatattctgcttacaaaacactgaactctttatattccgaaagcagaagcggcgtgcagtcagctattagtcaaactgcaaatcccgcgctttccagaagcgtttctcgttctggcatagaaagtcaaggacgcagtgcagatgctagccaaagagcagcagaaactattgtcagagatagccaaacgttaggtgatgtatatagccgcttacaggttctggattctttgatgtctacgattgtgagcaatccgcaagcaaatcaagaagagattatgcagaagctcacggcatctattagcaaagctccacaatttgggtatcctgctgttcagaattctgtggatagcttgcagaagtttgctgcacaattggaaagagagtttgttgatggggaacgtagtctcgcagaatctcaagagaatgcgtttagaaaacagcccgctttcattcaacaggtgttggtaaacattgcttctctattctctggttatctttcttaacgtgtgattgaagtttgtgaattgagggggagccaaaaaagaatttcttttttggctcttttttcttttcaaaggaatctcgtgtctacagaagtcttttcaataataagttcttagttccaaaagaagaaaatatataaaagaaaaaactcctaattcatttaaaaagtgctcggcagacttcgtggaaaatgtctgtaaagctggaggggaatcagcagaaagatgcaagatatccgagaaaaaaggctcaggctcgtgccgaattcggcacgagactacgaaagaaaggtcttttctttcggaatctgtcattggatctgcgtaagacttaaagttcggcaacacaggctctgtcttctctttaggtttcttgcgcgagaaaaattttctcaagtaacaagaagatttctttttacagccggcatccggcttctcgcgaagtataac

SEQ ID NO: 58 - DNA, 463 bp, Chlamydia trachomatis; identical to SEQ ID NO: 55

SEQ ID NO: 59 - DNA, 552 bp, Chlamydia trachomatis
acattcctcctgctcctcgcggccatccacaaattgaggtaaccttcgatattgatgccaacggaattttacacgtttctgctaaagatgctgctagtggacgcgaacaaaaaatccgtattgaagcaagctctggattaaaagaagatgaaattcaacaaatgatccgcgatgcagagcttcataaagaggaagacaaacaacgaaaagaagcttctgatgtgaaaaatgaagccgatggaatgatctttagagccgaaaaagctgtgaaagattaccacgacaaaattcctgcagaacttgttaaagaaattgaagagcatattgagaaagtacgccaagcaatcaaagaagatgcttccacaacagctatcaaagcagcttctgatgagttgagtactcgtatgcaaaaaatcggagaagctatgcaggctcaatccgcatccgcagcagcatcttctgcagcgaatgctcaaggagggccaaacattaactccgaagatctgaaaaaacatagtttcagcacacgacctccagcaggaggaagcgcct

SEQ ID NO: 60 - DNA, 1180 bp, Chlamydia trachomatis
atcctagcggtaaaactgcttactggtcagataaaatccatacagaagcaacacgtacttcttttaggagaaaaaatctataatgctagaaaaatcctgagtaaggatcacttctcctcaacaactttttcatcttggatagagttagtttttagaactaagtcttctgcttacaatgctcttgcatattacgagctttttataaacctccccaaccaaactctacaaaaagagtttcaatcgatcccctataaatccgcatatattttggccgctagaaaaggcgatttaaaaaccaaggtcgatgtgatagggaaagtatgtggaatctcgtgccgaattcggcacgagcggcacgaggatgtagagtaattagttaaagagctgcataattatgacaaagcatggaaaacgcattcgtggtatccaagagacttacgatttagctaagtcgtattctttgggtgaagcgatagatattttaaaacagtgtcctactgtgcgtttcgatcaaacggttgatgtgtctgttaaattagggatcgatccaagaaagagtgatcagcaaattcgtggttcggtttctttacctcacggtacaggtaaagttttgcgaattttagtttttgctgctggagataaggctgcagaggctattgaagcaggagcggactttgttggtagcgacgacttggtagaaaaaatcaaaggtggatgggttgacttcgatgttgcggttgccactcccgatatgatgagagaggtcggaaagctaggaaaagttttaggtccaagaaaccttatgcctacgcctaaagccggaactgtaacaacagatgtggttaaaactattgcggaactgcgaaaaggtaaaattgaatttaaagctgatcgagctggtgtatgcaacgtcggagttgcgaagctttctttcgatagtgcgcaaatcaaagaaaatgttgaagcgttgtgtgcagccttagttaaagctaagcccgcaactgctaaaggacaatatttagttaatttcactatttcctcgaccatggggccaggggttaccgtggatactagggagttgattgcgttataattctaagtttaaagaggaaaaatgaaagaagagaaaaagttgctgcttcgcgaggttgaagaaaagataaccgcttctcggcacgag

SEQ ID NO: 61 - DNA, 1215 bp, Chlamydia trachomatis
attacagcgtgtgcaggtaacgacatcattgcatgatgcttttgatggcattgatgcggcattccttatagggtcagttcctagaggcccaggaatggagagaagagatcttctaaagaaaaatggggagattgttgctacgcaaggaaaagctttgaacacaacagccaagcgggatgcaaagatttttgttgttgggaaccctgtgaataccaattgctggatagcaatgaatcatgctcccagattattgagaaagaactttcatgcgatgctacgattggaccagaatcgtatgcatagcatgttatcgcatagagcagaagtacctttatcggctgtatcacaagttgtggtttggggaaatcactccgccaaacaagtgcctgattttacgcaagctctgattaatgaccgtcctatcgcagagacgatagcggatcgtgattggttagagaatattatggtgccttctgtacagagtcgtggtagtgcagtaattgaagcacgagggaagtcttcggcagcttctgcagcacgagctttagcagaggctgctcgatcaatatatcagccaaaagaaggactcgtgccgaattcggcacgagtatcgaaattgcaggcatttctagtgaatggtcgtatgcttataaactacgtggtacagacttgagctctcaaaagtttgctacagattcttacatcgcagacccttattctaagaatatctactcccctcaactatttggatcccctaaacaagaaaaggattacgcatttagttacctgaaatatgaggattttgactgggaaggcgacactcctttgcaccttccaaaagaaaattacttcatttatgaaatgcatgttcggtcattcacccgagatccgtcttcccaggtttcccatcctggaactttccttggtatcatcgaaaaaatagaccacctcaaacaactaggcgttcatgcagttgaactccttcctattttcgaattcgatgaaaccgtccatccatttaaaaatcaggacttcccccacctgtgtaactattgggggtattcttcggtgaattttttctgcccctctcgccgttatacttatggggcagacccttgcgctccggcccgagagttcaagactcttgtcaaagcgttacaccgtgcgggaatcgaagtcattctcgatgtcgttttcaatcatacaggctttgaa

SEQ ID NO: 62 - DNA, 688 bp, Chlamydia trachomatis
gtggatccaaaaaagaatctaaaaagccatacaaagattgcgttacttcttgcgatgcctctaacactttatcagcgtcatctttgagaagcatctcaatgagcgctttttcttctctagcatgccgcacatccgcttcttcatgttctgtgaaatatgcatagtcttcaggattggaaaatccaaagtactcagtcaatccacgaattttctctctagcgatacgtggaatttgactctcataagaatacaaagcagccactcctgcagctaaagaatctcctgtacaccaccgcatgaaagtagctactttcgcttttgctgcttcactaggctcatgagcctctaactcttctggagtaactcctagagcaaacacaaactgcttccacaaatcaatatgattagggtaaccgttctcttcatccatcaagttatctaacaataacttacgcgcctctaaatcatcgcaacgactatgaatcgcagataaatatttaggaaaggctttgatatgtaaataatagtctttggcacgagcctgtaattgctctttagtaagctcccccttcgaccatttcacataaaacgtgtgttctagcatatgcttattttgaataattaaatctaactgatctaaaaaattcataaacacctccatcatttcttttcttgactccacgtaacc

SEQ ID NO: 63 - DNA, 269 bp, Chlamydia trachomatis
atgttgaaatcacacaagctgttcctaaatatgctacggtaggatctccctatcctgttgaaattactgctacaggtaaaagggattgtgttgatgttatcattactcagcaattaccatgtgaagcagagttcgtacgcagtgatccagcgacaactcctactgctgatggtaagctagtttggaaaattgaccgcttaggacaaggcgaaaagagtaaaattactgtatgggtaaaacctcttaaagaaggttgctgctttacagct

SEQ ID NO: 64 - DNA, 1339 bp, Chlamydia trachomatis
cttttattatggcttctggggatgatgtcaacgatatcgacctgctatctcgaggagattttaaaattgttatacagacggctccagaggagatgcatggattagcggactttttggctcccccggcgaaggatcttggtattctctccgcctgggaagctggtgagctgcgttacaaacagctagttaatccttaggaaacatttctggacctatgcccatcacattggctccgtgatccacatagagagtttctcccgtaattgcgctagctaggggagagactaagaaggctgctgctgcgcctacttgctcagcttccattggagaaggtagtggagcccagtcttggtagtaatccaccattctctcaataaatccaatagcttttcctgcacggctagctaatggccctgccgagatagtattcactcggactccccaacgtcggccggcttcccaagccagtacttttgtatcactttctaaagcagcttttgctgcgttcattcctccgccataccctggaacagcacgcatggaagcaagataagttagagagatggtgctagctcctgcattcataattgggccaaaatgagagagaaggctgataaaggagtagctggatgtacttaaggcggcaagatagcctttacgagaggtatcaagtaatggtttagcaatttccggactgtttgctaaagagtgaacaagaatatcaatgtgtccaaaatcttttttcacctgttctacaacttcggatacagtgtacccagaaagatctttgtaacgtttattttccaaaatttcctgaggaatatcttctggggtgtcgaaactggcatccatgggatagattttagcgaaagttagcaattctccattggagagttcacgagatgcattgaattttcctaactcccaagattgagagaaaattttatagataggaacccaggtccccacaagtatggttgcgcctgcttctgctaacattttggcaatgccccagccatacccgttatcatcgcctatgccggctatgaaagcaatttttcctgttaaatcaattttcaacatgagctaaccccattttgtcttcttgagagaggagagtagcagattctttattattgagaaacgggcctcataatacataaggagtagattcactggctggatccaggtttctagagtaaagagtttccttgtcaaattcttatatgggtagagttaatcaactgttttcaagtgatttatgtttattttaaaataatttgttttaacaactgtttaatagttttaatttttaaagtgtgaaaaacaggttttatat

SEQ ID NO: 65 - protein, 195 aa, Chlamydia trachomatis
MGSLVGRQAPDFSGKAVVCGEEKEISLADFRGKYVVLFFYPKDFTYVCPTELHAFQDRLVDFEEHGAVVLGCSVDDIETHSRWLTVARDAGGIEGTEYPLLADPSFKISEAFGVLNPEGSLALRATFLIDKHGVIRHAVINDLPLGRSIDEELRILDSLIFFENHGMVCPANWRSGERGMVPSEEGLKEYFQTMD

SEQ ID NO: 66 - DNA, 520 bp, Chlamydia
gatccgaattcggcacgaggaggaatggaagggccctccgattttaaatctgctaccatgccattcactagaaactccataacagcggttttctctgatggcgagtaagaagcaagcatttgatgtaaattagcgcaattagagggggatgaggttacttggaaatataaggagcgaagcgatgaaggagatgtatttgctctggaagcaaaggtttctgaagctaacagaacattgcgtcctccaacaatcgcctgaggattctggctcatcagttgatgctttgcctgaatgagagcggacttaagtttcccatcagagggagctatttgaattagataatcaagagctagatcctttattgtgggatcagaaaatttacttgtgagcgcatcgagaatttcgtcagaagaagaatcatcatcgaacgaatttttcaatcctcgaaaatcttctccagagacttcggaaagatcttctgtgaaacgatcttcaagaggagtatcgcctttttcctctg

SEQ ID NO: 67 - DNA, 276 bp, Chlamydia
gatccgaattcggcacgaggtattgaaggagaaggatctgactcgatctatgaaatcatgatgcctatctatgaagttatgaatatggatctagaaacacgaagatcttttgcggtacagcaagggcactatcaggacccaagagcttcagattatgacctcccacgtgctagcgactatgatttgcctagaagcccatatcctactccacctttgccttctagatatcagctacagaatatggatgtagaagcagggttccgtgaggcagtttat

SEQ ID NO: 68 - DNA, 248 bp, Chlamydia
gatccgaattcggcacgaggtgttcaagaatatgtccttcaagaatgggttaaattgaaagatctaccggtagaagagttgctagaaaaacgatatcagaaattccgaacgataggtctatatgaaacttcttctgaaagcgattctgaggcataagaagcatttagttttattcggtttttctcttttatccatattagggctaacgataacgtctcaagcagaaattttttctctaggtcttattg

SEQ ID NO: 69 - DNA, 715 bp, Chlamydia
  unsure (34): n=A,T,C or G
gatccgaattcggcacgagaaggtagatccgatntcagcaaaagtgctcctaaaggaagattccttcggtatcctgcagcaaataaggtggcacactccatctcggacagtttgagctttattttcatatagttttcgacggaactctttattaaactcccaaaaccgaatgttagtcgtgtgggtgatgcctatatggtaagggaggtttttggcttcgagaatattggtgatcattttttgtacgacaaaattagctaatgcagggacctctggggggaagtatgcatctgatgttccatcttttcggatgctagcaacagggacaaaataatctcctatttggtagtgggatcttaagcctccgcacatgcccaacatgatcgctgctgtagcattgggaaggaaagaacacagatctacggtaagagctgctcctggagagcctaatttaaaatcgatgattgaggtgtgaatttgaggcgcatgcgctgccgaaaacatggatcctcgagaaacagggacctgatagatttcagcgaaaacatccacggtaatacccmaaattagtaagaaggagatagggctggaactcttgaatggtagagccggtatagcgctctagcatgtcacaggcgattgtttcttcgctgatttttttatgttgatgggtcataaatcacagatattataatggttagagaatctttttttc

SEQ ID NO: 70 - DNA, 323 bp, Chlamydia
gatccgaattcggcacgagcagaacgtaaacagcacacttaaaccgtgtatgaggtttaacactgtttggcaagcaaacaaccattcctctttccacatcgttcttaccaatacctctgaggagcaatccaacattctctcctgcacgaccttctgggagttcttttctgaacatttcaaccccagtaacaatcgtttctttagtatctctaagaccgaccaactgaactttatcggaaactttaacaattccacgctcaatacgtccagttactacagttcctcgtccggagatagagaacacgtcctcaatgggcattaag

SEQ ID NO: 71 - DNA, 715 bp, Chlamydia
gatccgaattcggcacgaggaaaaaaagattctctaaccattataatatctgtgatttatgacccatcaacataaaaaaatcagcgaagaaacaatcgcctgtgacatgctagagcggctataccggctctaccattcaagagttccagccctatctccttcttactaattttgggtattacgtggatgttttcgctgaaatctatcaggtccctgtttctcgaggatccatgttttcgggcagcgcatgcgcctcaaattcacacctcaatcatcgattttaaattaggctctccaggagcagctcttaccgtagatctgtgttctttccttcccaatgctacagcagcgatcatgttgggcatgtgcggaggcttaagatcccactaccaaataggagattattttgtccctgttgctagcatccgaaaagatggaacatcagatgcatacttccccccagaggtccctgcattagctaattttgtcgtacaaaaaatgatcaccaatattctcgaagccaaaaacctcccttaccatataggcatcacccacacgactaacattcggttttgggagtttaataaagagttccgtcgaaaactatatgaaaataaagctcaaactgtcgagatggagtgtgccaccttatttgctgcaggataccgaaggaatcttcctttaggagcacttttgctgatatcggatctacctt

SEQ ID NO: 72 - DNA, 641 bp, Chlamydia
  unsure (550): n=A,T,C or G
  unsure (559): n=A,T,C or G
  unsure (575): n=A,T,C or G
  unsure (583): n=A,T,C or G
  unsure (634): n=A,T,C or G
  unsure (638): n=A,T,C or G
gatccgaattcggcacgagatctcctcgagctcgatcaaacccacacttgggacaagtacctacaacataacggtccgctaaaaacttcccttcttcctcagaatacagctgttcggtcacctgattctctaccagtccgcgttcctgcaagtttcgatagaaatcttgcacaatagcaggatgataagcgttcgtagttctggaaaagaaatctacagaaattcccaatttcttgaaggtatctttatgaagcttatgatacatgtcgacatattcttgataccccatgcctgccaactctgcattaagggtaattgcgattccgtattcatcagaaccacaaatatacaaaacctctttgccttgtagtctctgaaaacgcgcataaacatctgcaggcaaataagcaccggtaatatgtccaaaatgcaaaggaccatttgcgtaaggcaacgcagaagtaataagaatacgggaagattccactatttcacgtcgctccagttgtacagagaaggatcttttcttctggatgttccgaaaccttgntctcttcgnctctctcctgtagcanacaaatgnctctctcgacatctctttcagcgtattcggactgatgccctaaagatcccnggangtt

SEQ ID NO: 73 - DNA, 584 bp, Chlamydia
  unsure (460): n=A,T,C or G
  unsure (523): n=A,T,C or G
  unsure (541): n=A,T,C or G
  unsure (546): n=A,T,C or G
gaattcggcacgagacatttctagaatggaaccggcaacaaacaaaaactttgtatctgaagatgactttaagcaatctttagatagggaagattttttggaatgggtctttttatttgggacttattacggaacgagtaaggcggagatttctagagttctgcaaaagggtaagcactgcatagccgtgattgatgtacaaggagctttggctctgaagaagcaaatgccggcagtcactatttttattcaagctccctctcaagaagaacttgagcgccgtttgaatgctcgggattcagagaaagatttccagaagaaagaaagattagagcatagcgctgtcgaaattgctgccgctagcgaatttgattatgttgtggttaatgatgatttgattacagcatatcaagttttaagaagtatttttatagctgaagaacataggatgagtcatggntagaaaagatcgtttaactaatgaaagactgaataagctatttgatagcccctttagtttggntaattacgtaattaagcnagctnagaacaaaattgctagaggagatgttcgttcttctaac

SEQ ID NO: 74 - DNA, 465 bp, Chlamydia
gatccgaattcggcacgagctcgtgccgtttgggatcgtgtaatcgcatcggagaatggttaagaaattattttcgagtgaaagagctaggcgtaatcattacagatagccatactactccaatgcggcgtggagtactgggtatcgggctgtgttggtatggattttctccattacacaactatataggatcgctagattgtttcggtcgtcccttacagatgacgcaaagtaatcttgtagatgccttagcagttgcggctgttgtttgtatgggagaggggaatgagcaaacaccgttagcggtgatagagcaggcacctaatatggtctaccattcatatcctacttctcgagaagagtattgttctttgcgcatagatgaaacagaggacttatacggaccttttttgcaagcggttaccgtggagtcaagaaaagaaatgatggaggtgtttatgaatt

SEQ ID NO: 75 - DNA, 545 bp, Chlamydia
gaattcggcacgagatgaaaagttagcgtcacaggggattctcctaccaaagaattccgaaaagttttcttccaaaaacctcttcctctcttgattagtgatccctctgcaactactttactatatgttctgtgaaatatgcatagtcttcaggattggaaaatccaaagtactcagtcaatccacgaattttctctctagcgatacgtggaatttgactctcataagaatacaaagcagccactcctgcagctaaagaatctcctgtacaccaccgcatgaaagtagctactttcgcttttgctgcttcactaggctcatgagcctctaactcttctggagtaactcctagagcaaacacaaactgcttccacaaatcaatatgattagggtaaccgttctcttcatccatcaagttatctaacaataacttacgcgcctctaaatcatcgcaacgactatgaatcgcagataaatatttaggaaaggctttgatatgtaaataatagtctttggcatacgcctgtaattgctctttagtaagc

SEQ ID NO: 76 - DNA, 797 bp, Chlamydia
  unsure (788): n=A,T,C or G
  unsure (789): n=A,T,C or G
gatccgaattcggcacgagatacgctagatgcgataaatgcggataatgaggattatcctaaaccaggtgacttcccacgatcttccttctctagtacgcctcctcatgctccagtacctcaatctgagattccaacgtcacctacctcaacacagcctccatcaccctaacttgtaaaaactgtaataaaaagagcgcgcttcctttatgcaaaatcaatttgaacaactccttactgaattagggactcaaatcaacagccctcttactcctgattccaataatgcctgtatagttcgctttggatacaacaatgttgctgtacaaattgaagaggatggtaattcaggatttttagttgctggagtcatgcttggaaaacttccagagaatacctttagacaaaaaattttcaaagctgctttgtctatcaatggatctccgcaatctaatattaaaggcactctaggatacggtgaaatctctaaccaactctatctctgtgatcggcttaacatgacctatctaaatggagaaaagctcgcccgttacttagttcttttttcgcagcatgccaatatctggatgcaatctatctcaaaaggagaacttccagatttacatgctctaggtatgtatcacctgtaaattatgccgtcattatcccaatcccgacgtatcatccagcaatcttccattcgaaagatttggaatcagatagatacttctcctaagcatgggggtatgcgtaccggttatttttctcttcatactcaaaaaaagttgnnggggaata

SEQ ID NO: 77 - DNA, 399 bp, Chlamydia
catatgcatcaccatcaccatcacatgccacgcatcattggaattgatattcctgcaaagaaaaagttaaaaataagtctgacatatatttatggaataggatcagctcgttctgatgaaatcattaaaaagttgaagttagatcctgaggcaagagcctctgaattaactgaagaagaagtaggacgactgaactctctgctacaatcagaatataccgtagaaggggatttgcgacgtcgtgttcaatcggatatcaaaagattgatcgccatccattcttatcgaggtcagagacatagactttctttaccagtaagaggacaacgtacaaaaactaattctcgtactcgaaaaggtaaaagaaaaacagtcgcaggtaagaagaaataagaattc

SEQ ID NO: 78 - DNA, 285 bp, Chlamydia
atgcatcaccatcaccatcacatgagtcaaaaaaataaaaactctgcttttatgcatcccgtgaatatttccacagatttagcagttatagttggcaagggacctatgcccagaaccgaaattgtaaagaaagtttgggaatacattaaaaaacacaactgtcaggatcaaaaaaataaacgtaatatccttcccgatgcgaatcttgccaaagtctttggctctagtgatcctatcgacatgttccaaatgaccaaagccctttccaaacatattgtaaaataa

SEQ ID NO: 79 - DNA, 950 bp, Chlamydia
aaattaactcgagcacaaattacggcaattgctgagcaaaagatgaaggacatggatgtcgttcttttagagtccgccgagagaatggttgaagggactgcccgaagcatgggtgtagatgtagagtaattagttaaagagctgcataattatgacaaagcatggaaaacgcattcgtggtatccaagagacttacgatttagctaagtcgtattctttgggtgaagcgatagatattttaaaacagtgtcctactgtgcgtttcgatcaaacggttgatgtgtctgttaaattagggatcgatccaagaaagagtgatcagcaaattcgtggttcggtttctttacctcacggtacaggtaaagttttgcgaattttagtttttgctgctggagataaggctgcagaggctattgaagcaggagcggactttgttggtagcgacgacttggtagaaaaaatcaaaggtggatgggttgacttcgatgttgcggttgccactcccgatatgatgagagaggtcggaaagctaggaaaagttttaggtccaagaaaccttatgcctacgcctaaagccggaactgtaacaacagatgtggttaaaactattgcggaactgcgaaaaggtaaaattgaatttaaagctgatcgagctggtgtatgcaacgtcggagttgcgaagctttctttcgatagtgcgcaaatcaaagaaaatgttgaagcgttgtgtgcagccttagttaaagctaagcccgcaactgctaaaggacaatatttagttaatttcactatttcctcgaccatggggccaggggttaccgtggatactagggagttgattgcgttataattctaagtttaaagaggaaaaatgaaagaagagaaaaagttgctgcttcgcgaggttgaagaaaagataaccgcttctcaaggttttattttgttgagat

SEQ ID NO: 80 - DNA, 395 bp, Chlamydia
tttcaaggattttgttttcccgatcatcttactaaatgcagctccaacaatcacatcatgggctggtttagcatctaaggcaacagaagctcctctgctgtaataagtgaattcttcagaagtaggtgttcctacttgcgatagcatcgttcctagtcctgatatccacaggttgttatagctaacttcatcaaagcgagctagattcattttatcgttgagcaagccttgtttgactgtgaccattgacatttgagatcccagaatcgagttcgcatagaaatgattgtctctaggtacataagcccattgtctataagagtcaaatttccagagcgctgagatcgttccattttgtagttgatcaggatccagagtgagtgttcctgtatatc

SEQ ID NO: 81 - DNA, 2085 bp, Chlamydia
atttggcgaaggagtttgggctacggctattaataaatcattcgtgttcgctgcctccaagaccagattgtgtactttcttatgaagaatctcctattgagcaaatgttgcgttggggagagtctcagttagaacaatttgctcaagtaggtttagatacaagttggcaagttgttttcgatccaggaataggatttgggaagactcccgttcagtcgatgttattgatggatggagtaaagcagtttaaacgtgttttagagtgtcctgtattaataggccattctagaaaatcgtgtttgagtatgttgggccgatttaatagtgacgatcgtgattgggaaacgatcggctgttctgtatctcttcatgatcgaggagttgattatctacgtgtgcatcaggttgaaggtaacagacgtgccttagccgctgctgcttgggctggtatgtttgtatgatccaagcaacaggtatcgttgctattgatcccagaggagtgatgggagctttaggcaagctcccttggagttatcccgaagatctacgtttttttgcagaaaccattcgaaatcatcccatcattatgggacgaaagacttgggagtctcttccagacaagtataagcatgggcgggatatcgttgtcttttctcgcaggatgcatccaccacaatgcataggagtttcttcctttgcagagtatgggacactatctttgaatcatccgtttttaattgggggagcggagctctttgaaagttttttccaacaaaaccttctgaaagcttgttttgtcacacatatcaaaaagaaatattggggcgatactttcttccctatcacgcgattatcaggatggaagaaggaatgtatttgtaatacagaggatttcagtatttattattatgaaaataactccgatcaaaacacgtaaagtatttgcacatgattcgcttcaagagatcttgcaagaggctttgccgcctctgcaagaacggagtgtggtagttgtctcttcaaagattgtgagtttatgtgaaggcgctgtcgctgatgcaagaatgtgcaaagcagagttgataaaaaaagaagcggatgcttatttgttttgtgagaaaagcgggatatatctaacgaaaaaagaaggtattttgattccttctgcagggattgatgaatcgaatacggaccagccttttgttttatatcctaaagatattttgggatcgtgtaatcgcatcggagaatggttaagaaattattttcgagtgaaagagctaggcgtaatcattacagatagccatactactccaatgcggcgtggagtactgggtatcgggctgtgttggtatggattttctccattacacaactatataggatcgctagattgtttcggtcgtcccttacagatgacgcaaagtaatcttgtagatgccttagcagttgcggctgttgtttgtatgggagaggggaatgagcaaacaccgttagcggtgatagagcaggcacctaatatggtctaccattcatatcctacttctcgagaagagtattgttctttgcgcatagatgaaacagaggacttatacggaccttttttgcaagcggttacgtggagtcaagaaaagaaatgatggaggtgtttatgaattttttagatcagttagatttaattattcaaaataagcatatgctagaacacacgttttatgtgaaatggtcgaagggggagcttactaaagagcaattacaggcgtatgccaaagactattatttacatatcaaagcctttcctaaatatttatctgcgattcatagtcgttgcgatgatttagaggcgcgtaagttattgttagataacttgatggatgaagagaacggttaccctaatcatattgatttgtggaagcagtttgtgtttgctctaggagttactccagaagagttagaggctcatgagcctagtgaagcagcaaaagcgaaagtagctactttcatgcggtggtgtacaggagattctttagctgcaggagtggctgctttgtattcttatgagagtcaaattccacgtatcgcctc

SEQ ID NO: 82 - DNA, 405 bp, Chlamydia
ttcatcggtctagttcgctattctactctccaatggttccgcatttttgggcagagcttcgcaatcattatgcaacgagtggtttgaaaagcgggtacaatattgggagtaccgatgggtttctccctgtcattgggcctgttatatgggagtcggagggtcttttccgcgcttatatttcttcggtgactgatggggatggtaagagccataaagtaggatttctaagaattcctacatatagttggcaggacatggaagattttgatccttcaggaccgcctccttgggaagaattgtattggctccataaagggaggagaaaacttcgatatagggaatcgtatcaaggtgaaagtagcaaaaaataaattagctcctccattccgaactgcagaatttgat

SEQ ID NO: 83 - DNA, 379 bp, Chlamydia
tataccattcgtttgaaagtgcctttgacgggagaaagtgtttttgaagatcaatgcaaaggtcgtgtcgttttcccttgggcagatgttgacgatcaagttttggttaaatcagacgggttccctacgtatcactttgctaatgtagttgatgatcatttgatggggattacccatgtgttgcgaggggaagagtggttaagttctacacctaaacaccttcttctttacaaagcttttgggtgggagcctccgcagtttttccatatgccgcttcttctaaatcctgatggaagtaagctttccaagagaaagaatcctacttctattttttactatcgggatgctggatacaaaaaagaagcgttcatgaatttcc

SEQ ID NO: 84 - DNA, 715 bp, Chlamydia
tcaatcctgtattaataattctggttcttagactacataaattaggaacgcctgatgagtatccataactaatcgcgtagggcttagaatcaccttctcgtaccaaagctagaacaacgccgccttccattcttgatgcaataatatctgctgagactaagaacatgctcccagagcttttgggtgtgactgtgaattttcctatttcagttcctcctaataaagtttcaatgttcctgggagtgaataacccgttgcattgaattttattagtgattggaaagttgttaaaagctttcaacaaacctagagaagggtctgttgtgattttgtctaaaatatcttggactgtactatcaacaatagtatcagcaattccaccaagaatttgatctcccaacttttctagaataagctggtaagctttttccgcatccaaaccaattgtaatagaagcattggttgatggattattggagactgttaaagatattccatcagaagctgtcattttggctgcgacaggtgttgatgttgtcccaaggattatttgctggtccttgagcggctctgtcatttgcccaactttgatattatcagcaaagacgcagttttgagtgttatacaaataaaaaccagaatttcccattttaaaactcttttttattttgagctttaaataaattaggtttttagtttcaagtttgctattaat

SEQ ID NO: 85 - DNA, 476 bp, Chlamydia
ctcgtgccgctcgtgccgctcgtgccggtcttttagaagagcgtgaagctttaaataattcgattacgtttatcatggataagcgtaattggatagaaaccgagtctgaacaggtacaagtggttttcagagatagtacagcttgcttaggaggaggcgctattgcagctcaagaaattgtttctattcagaacaatcaggctgggatttccttcgagggaggtaaggctagtttcggaggaggtattgcgtgtggatctttttcttccgcaggcggtgcttctgttttagggactattgatatttcgaagaatttaggcgcgatttcgttctctcgtactttatgtacgacctcagatttaggacaaatggagtaccagggaggaggagctctatttggtgaaaatatttctctttctgagaatgctggtgtgctcacctttaaagacaacattgtgaagacttttgcttcgaat

SEQ ID NO: 86 - DNA, 1551 bp, Chlamydia
gcgtatcgatatttcttctgttacattctttatagggattctgttggctgttaatgcgctaacctactctcatgtattacgggatttatctgtgagtatggatgcgctgttttctcgtaacacgcttgctgttcttttaggtttagtctctagcgttttagataatgtgccattagtcgctgcaacaataggtatgtatgacttacctatgaacgatcctctttggaaactcattgcctatacagcaggcacagggggaagtattctcatcattggatccgctgcaggtgttgcctacatgggaatggaaaaagtgagtttcggctggtatgtcaaacacgcttcttggattgctttagccagttattttggaggtctagcagtctattttctaatggaaaattgtgtgaatttgttcgtttgaggtagtcagtatggcagagtttctttaaaaattcttttaataaaagggttctctgcctattctaggcccctttttgaatggaaaaatgggtttttggagaacatcgattatgaaaatgaataggatttggctattactgcttaccttttcttctgccatacattctcctgtacgaggagaaagcttggtttgcaagaatgctcttcaagatttgagttttttagagcatttattacaggttaaatatgctcctaaaacatggaaagagcaatacttaggatgggatcttgttcaaagctccgtttctgcacagcagaagcttcgtacacaagaaaatccatcaacaagtttttgccagcaggtccttgctgattttatcggaggattaaatgactttcacgctggagtaactttctttgcgatagaaagtgcttaccttccttataccgtacaaaaaagtagtgacggccgtttctactttgtagatatcatgactttttcttcagagatccgtgttggagatgagttgctagaggtggatggggcgcctgtccaagatgtgctcgctactctatatggaagcaatcacaaagggactgcagctgaagagtcggctgctttaagaacactattttctcgcatggcctctttagggcacaaagtaccttctgggcgcactactttaaagattcgtcgtccttttggtactacgagagaagttcgtgtgaaatggcgttatgttcctgaaggtgtaggagatttggctaccatagctccttctatcagggctccacagttacagaaatcgatgagaagctttttccctaagaaagatgatgcgtttcatcggtctagttcgctattctactctccaatggttccgcatttttgggcagagcttcgcaatcattatgcaacgagtggtttgaaaagcgggtacaatattgggagtaccgatgggtttctccctgtcattgggcctgttatatgggagtcggagggtcttttccgcgcttatatttcttcggtgactgatggggatggtaagagccataaagtaggatttctaagaattcctacatatagttggcaggacatggaagattttgatccttcaggaccgcctc

SEQ ID NO: 87 - DNA, 3031 bp, Chlamydia
atgtaggccctcaagcggttttattgttagaccaaattcgagatctattcgttgggtctaaagatagtcaggctgaaggacagtataggttaattgtaggagatccaagttctttccaagagaaagatgcagatactcttcccgggaaggtagagcaaagtactttgttctcagtaaccaatcccgtggttttccaaggtgtggaccaacaggatcaagtctcttcccaagggttaatttgtagttttacgagcagcaaccttgattctccccgtgacggagaatcttttttaggtattgcttttgttggggatagtagtaaggctggaatcacattaactgacgtgaaagcttctttgtctggagcggctttatattctacagaagatcttatctttgaaaagattaagggtggattggaatttgcatcatgttcttctctagaacaggggggagcttgtgcagctcaaagtattttgattcatgattgtcaaggattgcaggttaaacactgtactacagccgtgaatgctgaggggtctagtgcgaatgatcatcttggatttggaggaggcgctttctttgttacgggttctctttctggagagaaaagtctctatatgcctgcaggagatatggtagttgcgaattgtgatggggctatatcttttgaaggaaacagcgcgaactttgctaatggaggagcgattgctgcctctgggaaagtgctttttgtcgctaatgataaaaagacttcttttatagagaaccgagctttgtctggaggagcgattgcagcctcttctgatattgcctttcaaaactgcgcagaactagttttcaaaggcaattgtgcaattggaacagaggataaaggttctttaggtggaggggctatatcttctctaggcaccgttcttttgcaagggaatcacgggataacttgtgataataatgagtctgcttcgcaaggaggcgccatttttggcaaaaattgtcagatttctgacaacgaggggccagtggttttcagagatagtacagcttgcttaggaggaggcgctattgcagctcaagaaattgtttctattcagaacaatcaggctgggatttccttcgagggaggtaaggctagtttcggaggaggtattgcgtgtggatctttttcttccgcaggcggtgcttctgttttagggactattgatatttcgaagaatttaggcgcgatttcgttctctcgtactttatgtacgacctcagatttaggacaaatggagtaccagggaggaggagctctatttggtgaaaatatttctctttctgagaatgctggtgtgctcacctttaaagacaacattgtgaagacttttgcttcgaatgggaaaattctgggaggaggagcgattttagctactggtaaggtggaaattaccaataattccggaggaatttcttttacaggaaatgcgagagctccacaagctcttccaactcaagaggagtttcctttattcagcaaaaaagaagggcgaccactctcttcaggatattctgggggaggagcgattttaggaagagaagtagctattctccacaacgctgcagtagtatttgagcaaaatcgtttgcagtgcagcgaagaagaagcgacattattaggttgttgtggaggaggcgctgttcatgggatggatagcacttcgattgttggcaactcttcagtaagatttggtaataattacgcaatgggacaaggagtctcaggaggagctcttttatctaaaacagtgcagttagctggaaatggaagcgtcgatttttctcgaaatattgctagtttgggaggacgcaatgttctgttagcttcagaaacctttgcttccagagcaaatacatctccttcatcgcttcgctccttatatttccaagtaacctcatccccctctaattgcgctaatttacatcaaatgcttgcttcttactcgccatcagagaaaaccgctgttatggagtttctagtgaatggcatggtagcagatttaaaatcggagggcccttccattcctcctgcaaaattgcaagtatatatgacggaactaagcaatctccaagccttacactctgtagatagcttttttgatagaaatattgggaacttggaaaatagcttaaagcatgaaggacatgcccctattccatccttaacgacaggaaatttaactaaaaccttcttacaattagtagaagataaattcccttcctcttccaaagctcaaaaggcattaaatgaactggtaggcccagatactggtcctcaaactgaagttttaaacttattcttccgcgctcttaatggctgttcgcctagaatattctctggagctgaaaaaaaacagcagctggcatcggttatcacaaatacgctagatgcgataaatgcggataatgaggattatcctaaaccaggtgacttcccacgatcttccttctctagtacgcctcctcatgctccagtacctcaatctgagattccaacgtcacctacctcaacacagcctccatcaccctaacttgtaaaaactgtaataaaaagagcgcgcttcctttatgcaaaatcaatttgaacaactccttactgaattagggactcaaatcaacagccctcttactcctgattccaataatgcctgtatagttcgctttggatacaacaatgttgctgtacaaattgaagaggatggtaattcaggatttttagttgctggagtcatgcttggaaaacttccagagaatacctttagacaaaaaattttcaaagctgctttgtctatcaatggatctccgcaatctaatattaaaggcactctaggatacggtgaaatctctaaccaactctatctctgtgatcggcttaacatgacctatctaaatggagaaaagctcgcccgttacttagttcttttttcgcagcatgccaatatctggatgcaatctatctcaaaaggagaacttccagatttacatgctctag

SEQ ID NO: 88 - DNA, 976 bp, Chlamydia
aggtggatggggcgcctgtccaagatgtgctcgctactctatatggaagcaatcacaaagggactgcagctgaagagtcggctgctttaagaacactattttctcgcatggcctctttagggcacaaagtaccttctgggcgcactactttaaagattcgtcgtccttttggtactacgagagaagttcgtgtgaaatggcgttatgttcctgaaggtgtaggagatttggctaccatagctccttctatcagggctccacagttacagaaatcgatgagaagctttttccctaagaaagatgatgcgtttcatcggtctagttcgctattctactctccaatggttccgcatttttgggcagagcttcgcaatcattatgcaacgagtggtttgaaaagcgggtacaatattgggagtaccgatgggtttctccctgtcattgggcctgttatatgggagtcggagggtcttttccgcgcttatatttcttcggtgactgatggggatggtaagagccataaagtaggatttctaagaattcctacatatagttggcaggacatggaagattttgatccttcaggaccgcctccttgggaagaatttgctaagattattcaagtattttcttctaatacagaagctttgattatcgaccaaacgaacaacccaggtggtagtgtcctttatctttatgcactgctttccatgttgacagaccgtcctttagaacttcctaaacatagaatgattctgactcaggatgaagtggttgatgctttagattggttaaccctgttggaaaacgtagacacaaacgtggagtctcgccttgctctgggagacaacatggaaggatatactgtggatctacaggttgccgagtatttaaaaagctttggacgtcaagtattgaattgttggagtaaaggggatatcgagttatcaacacctattcctctttttggttttga

SEQ ID NO: 89 - protein, 94 aa, Chlamydia
MHHHHHHMSQKNKNSAFMHPVNISTDLAVIVGKGPMPRTEIVKKVWEYIKKHNCQDQKNKRNILPDANLAKVFGSSDPIDMFQMTKALSKHIVK

SEQ ID NO: 90 - protein, 474 aa, Chlamydia
MASHHHHHHMNEAFDCVVIGAGPGGYVAAITAAQAGLKTALIEKREAGGTCLNRGCIPSKALLAGAEVVTQIRHADQFGIHVEGFSINYPAMVQRKDSVVRSIRDGLNGLIRSNKITVFSGRGSLISSTEVKILGENPSVIKAHSIILATGSEPRAFPGIPFSAESPRILCSTGVLNLKEIPQKMAIIGGGVIGCEFASLFHTLGSEVSVIEASSQILALNNPDISKTMFDKFTRQGLRFVLEASVSNIEDIGDRVRLTINGNVEEYDYVLVSIGRRLNTENIGLDKAGVICDERGVIPTDATMRTNVPNIYAIGDITGKWQLAHVASHQGIIAARNIGGHKEEIDYSAVPSVIFTFPEVASVGLSPTAAQQQKIPVKVTKFPFRAIGKAVAMGEADGFAAIISHETTQQILGAYVIGPHASSLISEITLAVRNELTLPCIYETIHAHPTLAEVWAESALLAVDTPLHMPPAKK

SEQ ID NO: 91 - protein, 129 aa, Chlamydia
MHHHHHHMPRIIGIDIPAKKKLKISLTYIYGIGSARSDEIIKKLKLDPEARASELTEEEVGRLNSLLQSEYTVEGDLRRRVQSDIKRLIAIHSYRGQRHRLSLPVRGQRTKTNSRTRKGKRKTVAGKKK

SEQ ID NO: 92 - protein, 202 aa, Chlamydia
MHHHHHHMGSLVGRQAPDFSGKAVVCGEEKEISLADFRGKYVVLFFYPKDFTYVCPTELHAFQDRLVDFEEHGAVVLGCSVDDIETHSRWLTVARDAGGIEGTEYPLLADPSFKISEAFGVLNPEGSLALRATFLIDKHGVIRHAVINDLPLGRSIDEELRILDSLIFFENHGMVCPANWRSGERGMVPSEEGLKEYFQTMD

SEQ ID NO: 93 - protein, 19 aa, Artificial Sequence
  made in a lab
ENSLQDPTNKRNINPDDKL

SEQ ID NO: 94 - protein, 20 aa, Artificial Sequence
  Made in a lab
DPTNKRNINPDDKLAKVFGT

SEQ ID NO: 95 - protein, 20 aa, Artificial Sequence
  Made in a lab
KRNINPDDKLAKVFGTEKPI

SEQ ID NO: 96 - protein, 20 aa, Artificial Sequence
  Made in a lab
DDKLAKVFGTEKPIDMFQMT

SEQ ID NO: 97 - protein, 20 aa, Artificial Sequence
  Made in a lab
KVFGTEKPIDMFQMTKMVSQ

SEQ ID NO: 98 - protein, 20 aa, Artificial Sequence
  Made in a lab
NKRNINPDDKLAKVFGTEKP

SEQ ID NO: 99 - protein, 16 aa, Artificial Sequence
  Made in a lab
NKRNILPDANLAKVFG

SEQ ID NO: 100 - protein, 15 aa, Artificial Sequence
  Made in a lab
KMWDYIKENSLQDPT

SEQ ID NO: 101 - protein, 20 aa, Artificial Sequence
  Made in a lab
TEIVKKVWEYIKKHNCQDQK

SEQ ID NO: 102 - protein, 20 aa, Artificial Sequence
  Made in a lab
KVWEYIKKHNCQDQKNKRNI

SEQ ID NO: 103 - protein, 15 aa, Artificial Sequence
  Made in a lab
KVWEYIKKHNCQDQK

SEQ ID NO: 104 - protein, 20 aa, Artificial Sequence
  Made in a lab
AELTEEEVGRLNALLQSDYV

SEQ ID NO: 105 - protein, 21 aa, Artificial Sequence
  Made in a lab
LQSDYVVEGDLRRRVQSDIKR

SEQ ID NO: 106 - protein, 20 aa, Artificial Sequence
  Made in a lab
MPRIIGIDIPAKKKLKISLT

SEQ ID NO: 107 - protein, 20 aa, Artificial Sequence
  Made in a lab
AELTEEEVGRLNALLQSDYV

SEQ ID NO: 108 - protein, 20 aa, Artificial Sequence
  Made in a lab
LNALLQSDYVVEGDLRRRVQ

SEQ ID NO: 109 - protein, 20 aa, Artificial Sequence
  Made in a lab
LNSLLQSEYTVEGDLRRRVQ

SEQ ID NO: 110 - DNA, 1461 bp, Chlamydia
ctatctatgaagttatgaatatggatctagaaacacgaagatcttttgcggtacagcaagggcactatcaggacccaagagcttcagattatgacctcccacgtgctagcgactatgatttgcctagaagcccatatcctactccacctttgccttctagatatcagctacagaatatggatgtagaagcagggttccgtgaggcagtttatgcttcttttgtagcaggaatgtacaattatgtagtgacacagccgcaagagcgtattcccaatagtcagcaggtggaagggattctgcgtgatatgcttaccaacgggtcacagacatttagcaacctgatgcagcgttgggatagagaagtcgatagggaataaactggtatctaccataggtttgtatcaaaaaactaagcccaccaagaagaaattctctttggtgggcttctttttttattcaaaaaagaaagccctcttcaagattatctcgtgccgctcgtgccgaattcggcacgagcggcacgaggagctgtaagtaagtattgccaagagttggaagaaaaaatattagatttgtgtaagcgtcatgccgcaacaatttgctccattgaggaggatgctaaacaagaaattcgtcatcagacagaaaggtttaaacagcggttgcaacaaaatcagaacacttgcagtcaattaacagcagagttgtgtaaattgagatctgagaataaggcattatcggagcggctgcaggtgcaggcatcccgtcgtaaaaaataattaaagactcctcagatattgcatctgagagttaggggttccttttgcttacggcgctttagttctgcatgttgcggatttatagtgatttgcgagtaaagcgccgttctgatacagtttttccgctttaaaaataaaaaggtggaaaaatgagtactactattagcggagacgcttcttctttaccgttgccaacagcttcctgcgtagagacaaaatctacttcgtcttcaacaaaagggaatacttgttccaaaattttggatatagctttagctatcgtaggcgctttagttgttgtcgctggggtattagctttggttttgtgcgctagcaatgtcatatttactgtaataggtattcctgcattaattattggatctgcttgtgtgggtgcgggaatatctcgtcttatgtatcgatcctcttatgctagcttagaagcaaaaaatgttttggctgagcaacgtttgcgtaatctttcagaagagaaggacgctttggcctccgtctctttcattaataagatgtttctgcgaggtcttacggacgatctccaagctttggaagctaaggtaatggaatttgagattgattgtttggacagattagagaaaaatgagcaagctttattgtccgatgtgcgcttagttttatctagctacacaagatggttggatag

SEQ ID NO: 111 - DNA, 267 bp, Chlamydia
gtcctcttcttattatagcagaagacattgaaggcgaagctttagctactttggtcgtgaacagaattcgtggaggattccgggtttgcgcagttaaagctccaggctttggagatagaagaaaagctatgttggaagacatcgctatcttaactggcggtcaactcattagcgaagagttgggcatgaaattagaaaacgctaacttagctatgttaggtaaagctaaaaaagttatcgtttctaaagaagacacgaccatcgtcg

SEQ ID NO: 112 - DNA, 698 bp, Chlamydia
tgataagcaagcaaccgctcaactagcagctctaactattaaaaaaatcctctgttttgatgaaaattcctacgagaaggagctggcatgcttagaaaagaaacgcagtagcgtacaaaaagatctgagccaactgaaaaaatacacagttctctacatcaagaagctgctcgaaacctacagacaactcgggcatcgaaagacaaaaattgcaaaatttgatgacctacctaccgagagagtctccgctcataagaaagcaaaagaactcgctgcgctcgatcaagaagagaacttctaaaacgtgactcggcccttgagatccttaaactctcgggccaaaaagactacagtcttctcgagaagaaaaacggtgttagaaaatacgcgcgctaagactttctctaacaatgactcaaaaagctgtaaacgtatacgtttaccgctcttccataatttctaggctgactttcacattatctcgacttgctacggaaaccaataaagtacggatagccttaatagtgcgtccttctttaccgataattttaccgatatctcccttagcaacagtcaattcgtagataatcgtattggttccctgcacctctttcagatgcacttcctctggcttatcaacaagattttttacaatgtacgctaaaaactctttcatgcgaagcaaatcctacacaagc

SEQ ID NO: 113 - DNA, 1142 bp, Chlamydia
ctcttcaaagattgtgagtttatgtgaaggcgctgtcgctgatgcaagaatgtgcaaagcagagttgataaaaaaagaagcggatgcttatttgttttgtgagaaaagcgggatatatctaacgaaaaaagaaggtattttgattccttctgcagggattgatgaatcgaatacggaccagccttttgttttatatcctaaagatattttgggatcgtgtaatcgcatcggagaatggttaagaaattattttcgagtgaaagagctaggcgtaatcattacagatagccatactactccaatgcggcgtggagtactgggtatcgggctgtgttggtatggattttctccattacacaactatataggatcgctagattgtttcggtcgtcccttacagatgacgcaaagtaatcttgtagatgccttagcagttgcggctgttgtttgtatgggagaggggaatgagcaaacaccgttagcggtgatagagcaggcacctaatatggtctaccattcatatcctacttctcgagaagagtattgttctttgcgcatagatgaaacagaggacttatacggaccttttttgcaagcggttacgtggagtcaagaaaagaaatgatggaggtgtttatgaattttttagatcagttagatttaattattcaaaataagcatatgctagaacacacgttttatgtgaaatggtcgaagggggagcttactaaagagcaattacaggcgtatgccaaagactattatttacatatcaaagcctttcctaaatatttatctgcgattcatagtcgttgcgatgatttagaggcgcgtaagttattgttagataacttgatggatgaagagaacggttaccctaatcatattgatttgtggaagcagtttgtgtttgctctaggagttactccagaagagttagaggctcatgagcctagtgaagcagcaaaagcgaaagtagctactttcatgcggtggtgtacaggagattctttagctgcaggagtggctgctttgtattcttatgagagtcaaattccacgtatcgctagagagaaaattcgtggattgactgagtactttggattttccaatcctgaagactatgcatatttcacagaaca

SEQ ID NO: 114 - DNA, 976 bp, Chlamydia; identical to SEQ ID NO: 88

SEQ ID NO: 115 - DNA, 995 bp, Chlamydia
ttatcctagaaatttggtgttcaatatgagcgaaaaaagaaagtctaacaaaattattggtatcgacctagggacgaccaactcttgcgtctctgttatggaaggtggccaacctaaagttattgcctcttctgaaggaactcgtactactccttctatcgttgcttttaaaggtggcgaaactcttgttggaattcctgcaaaacgtcaggcagtaaccaatcctgaaaaaacattggcttctactaagcgattcatcggtagaaaattctctgaagtcgaatctgaaattaaaacagtcccctacaaagttgctcctaactcgaaaggagatgcggtctttgatgtggaacaaaaactgtacactccagaagaaatcggcgctcagatcctcatgaagatgaaggaaactgctgaggcttatctcggagaaacagtaacggaagcagtcattaccgtaccagcttactttaacgattctcaaagagcttctacaaaagatgctggacgtatcgcaggattagatgttaaacgcattattcctgaaccaacagcggccgctcttgcttatggtattgataaggaaggagataaaaaaatcgccgtcttcgacttaggaggaggaactttcgatatttctatcttggaaatcggtgacggagtttttgaagttctctcaaccaacggggatactcacttgggaggagacgacttcgacggagtcatcatcaactggatgcttgatgaattcaaaaaacaagaaggcattgatctaagcaaagataacatggctttgcaaagattgaaagatgctgctgaaaaagcaaaaatagaattgtctggtgtatcgtctactgaaatcaatcagccattcatcactatcgacgctaatggacctaaacatttggctttaactctaactcgcgctcaattcgaacacctagcttcctctctcattgagcgaaccaaacaaccttgtgctcaggctttaaaag

SEQ ID NO: 116 - DNA, 437 bp, Chlamydia
gtcacagctaaaggcggtgggctttatactgataagaatctttcgattactaacatcacaggaattatcgaaattgcaaataacaaagcgacagatgttggaggtggtgcttacgtaaaaggaacccttacttgtaaaaactctcaccgtctacaatttttgaaaaactcttccgataaacaaggtggaggaatctacggagaagacaacatcaccctatctaatttgacagggaagactctattccaagagaatactgccaaaaaagagggcggtggactcttcataaaaggtacagataaagctcttacaatgacaggactggatagtttctgtttaattaataacacatcagaaaaacatggtggtggagcctttgttaccaaagaaatctctcagacttacacctctgatgtggaaacaattccaggaatcac

SEQ ID NO: 117 - DNA, 446 bp, Chlamydia
aagtttacctagaccaaactgaagatgacgaaggaaaagttgttttatccagagaaaaagcaacaagacaacgacaatgggaatacattcttgctcactgcgaggaaggttctattgttaagggacaaattacccgaaaagttaagggtggtttgatcgtagatattggtatggaagccttccttccaggatcccaaatagacaataagaagatcaagaacttagatgattacgtaggcaaggtttgtgagttcaaaattctcaaaatcaacgtggatcgtcggaacgttgttgtatctagaagagaacttctcgaagctgaacgcatttctaagaaagcagagttgatcgagcaaatcactatcggtgaacgtcgcaaaggtatcgttaagaatatcacagatttcggagtattcttggatcttgatggcattgacggcctactc

SEQ ID NO: 118 - DNA, 951 bp, Chlamydia
agtattgcgaaatattactgtgagaagcaatgctgagagcggttctagtaaaagtgaggggagagctgtcagaagggatcgctcaggaagcgagacaacgtgtggctgatttattaggaagattccctctttatcctgaaatcgatctggaaacgctagtttagtgggagactctatgcctgaaggggaaatgatgcataagttgcaagatgtcatagatagaaagttgttggattctcgtcgtattttcttctccgaacctgtaacggagaaaagtgctgcagaagccatcaaaaagctttggtatttggaactcaccaatcctgggcagccaattgtatttgtcattaatagccctggagggtctgttgatgctgggtttgctgtttgggaccaaattaaaatgatctcttctcctttgactacagttgttacaggtttagcagcatctatgggatctgtattgagtttgtgtgctgttccaggaagacgttttgctacgcctcatgcgcgcattatgattcaccagccttctattggaggaaccattactggtcaagccacggacttggatattcatgctcgtgaaattttaaaaacaaaagcacgcattattgatgtgtatgtcgaggcaactggacaatctccagaggtgatagagaaagctatcgatcgagatatgtggatgagtgcaaatgaagcaatggagtttggactgttagatgggattctcttctcttttaacgacttgtagatatcttttatattctggagcaggaaacagtttcattttgggagaatcgatgccttctcttgaggatgttctgtttttatgccaggaagagatggttgatgggtttttatgtgtagagtcttctgaaatagcagatgctaaactcactgtttttaatagtgatggatctatcgcgtctatgtgcgggaatgggttgc

SEQ ID NO: 119 - DNA, 953 bp, Chlamydia
atatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaaacaatttttattggatttttcttataggttttatatttagagaaaaaagttcgaattacggggtttgttatgcaaaataaaagcaaagtgagggacgattttattaaaattgttaaagattcctggtatcggtctgcgattccgactcgtccaacatcaatacaacctattaatttcccctcgtcaaaaataaggttatcaagtgagaaatca

SEQ ID NO: 120 - DNA, 897 bp, Chlamydia
  misc_feature (1)...(897): n = A, C, T or G
atggcttctatatgcggacgtttagggtctggtacagggaatgctctaaaagctttttttacacagcccagcaataaaatggcaagggtagtaaataagacgaagggaatggataagactgttaaggtcgccaagtctgctgccgaattgaccgcaaatattttggaacaagctggaggcgcgggctcttccgcacacattacagcttcccaagtgtccaaaggattaggggatgcgagaactgttctcgctttagggaatgcctttaacggagcgttgccaggaacagttcaaagtgcgcaaagcttcttctcttacatgaaagctgctagtcagaaaccgcaagaaggggatgaggggctcgtagcagatctttgtgtgtctcataagcgcanagcggctgcggctgtctgtagcttcatcggaggaattacctacctcgcgacattcggagctatccgtccgattctgtttgtcaacaaaatgctggcgcaaccgtttctttcttcccaaattaaagcaaatatgggatcttctgttagctatattatggcggctaaccatgcagcgtttgtggtgggttctggactcgctatcagtgcggaaagagcagattgcgaagcccgctgcgctcgtattgcgagagaagagtcgtcactcgaattgtcgggagaggaaaatgcttgcgagaggagagtcgctggagagaaagccaagacgttcacgcgcatcaagtatgcactcctcactatgctcgagaagtttttggaatgcgttgccgacgttttcaaattggtgccgttgcctattacaatgggtattcgtgcaattgtggctgcgggatgtacgttcacttctgcagttattggattgtggactttctgcgccagagcataa

SEQ ID NO: 121 - protein, 298 aa, Chlamydia
MASICGRLGSGTGNALKAFFTQPSNKMARVVNKTKGMDKTVKVAKSAAELTANILEQAGGAGSSAHITASQVSKGLGDARTVLALGNAFNGALPGTVQSAQSFFSYMKAASQKPQEGDEGLVADLCVSHKRRAAAAVCSFIGGITYLATFGAIRPILFVNKMLAQPFLSSQIKANMGSSVSYIMAANHAAFVVGSGLAISAERADCEARCARIAREESSLELSGEENACERRVAGEKAKTFTRIKYALLTMLEKFLECVADVFKLVPLPITMGIRAIVAAGCTFTSAVIGLWTFCARA

SEQ ID NO: 122 - DNA, 897 bp, Chlamydia
atggcttctatatgcggacgtttagggtctggtacagggaatgctctaaaagctttttttacacagcccagcaataaaatggcaagggtagtaaataagacgaagggaatggataagactgttaaggtcgccaagtctgctgccgaattgaccgcaaatattttggaacaagctggaggcgcgggctcttccgcacacattacagcttcccaagtgtccaaaggattaggggatacgagaactgttgtcgctttagggaatgcctttaacggagcgttgccaggaacagttcaaagtgcgcaaagcttcttctctcacatgaaagctgctagtcagaaaacgcaagaaggggatgaggggctcacagcagatctttgtgtgtctcataagcgcagagcggctgcggctgtctgtggcttcatcggaggaattacctacctcgcgacattcggagttatccgtccgattctgtttgtcaacaaaatgctggtgaacccgtttctttcttcccaaactaaagcaaatatgggatcttctgttagctatattatggcggctaaccatgcagcgtctgtggtgggtgctggactcgctatcagtgcggaaagagcagattgcgaagcccgctgcgctcgtattgcgagagaagagtcgttactcgaagtgtcgggagaggaaaatgcttgcgagaagagagtcgctggagagaaagccaagacgttcacgcgcatcaagtatgcactcctcactatgctcgagaagtttttggaatgcgttgccgacgttttcaaattggtgccgctgcctattacaatgggtattcgtgcgattgtggctgctggatgtacgttcacttctgcaattattggattgtgcactttctgcgccagagcataa

SEQ ID NO: 123 - protein, 298 aa, Chlamydia
MASICGRLGSGTGNALKAFFTQPSNKMARVVNKTKGMDKTVKVAKSAAELTANILEQAGGAGSSAHITASQVSKGLGDTRTVVALGNAFNGALPGTVQSAQSFFSHMKAASQKTQEGDEGLTADLCVSHKRRAAAAVCGFIGGITYLATFGVIRPILFVNKMLVNPFLSSQTKANMGSSVSYIMAANHAASVVGAGLAISAERADCEARCARIAREESLLEVSGEENACEKRVAGEKAKTFTRIKYALLTMLEKFLECVADVFKLVPLPITMGIRAIVAAGCTFTSAIIGLCTFCARA

SEQ ID NO: 124 - DNA, 897 bp, Chlamydia; identical to SEQ ID NO: 16

SEQ ID NO: 125 - protein, 298 aa, Chlamydia; identical to SEQ ID NO: 17

SEQ ID NO: 126 - DNA, 897 bp, Chlamydia; identical to SEQ ID NO: 16

SEQ ID NO: 127 - protein, 298 aa, Chlamydia; identical to SEQ ID NO: 17

SEQ ID NO: 128 - DNA, 897 bp, Chlamydia
atggcttctatatgtggacgtttagggtctggtacagggaatgctctaaaagctttttttacacagcccagcaataaaatggcaagggtagtaaataagacgaagggaatggataagactgttaaggtcgccaagtctgctgccgaattgaccgcaaatattttggaacaagctggaggcgcgggctcttccgcacacattacagcttcccaagtgtccaaaggattaggggatacgagaactgttgtcgctttagggaatgcctttaacggagcgttgccaggaacagttcaaagtgcgcaaagcttcttctctcacatgaaagctgctagtcagaaaacgcaagaaggggatgaggggctcacagcagatctttgtgtgtctcataagcgcagagcggctgcggctgtctgtggcttcatcggaggaattacctacctcgcgacattcggagttatccgtccgattctgtttgtcaacaaaatgctggtgaacccgtttctttcttcccaaactaaagcaaatatgggatcttctgttagctatattatggcggctaaccatgcagcgtctgtggtgggtgctggactcgctatcagtgcggaaagagcagattgcgaagcccgctgcgctcgtattgcgagagaagagtcgttactcgaagtgtcgggagaggaaaatgcttgcgagaagagagtcgctggagagaaagccaagacgttcacgcgcatcaagtatgcactcctcactatgctcgagaagtttttggaatgcgttgccgacgttttcaaattggtgccgctgcctattacaatgggtattcgtgcgattgtggctgctggatgtacgttcacttctgcaattattggattgtgcactttctgcgccagagcataa

SEQ ID NO: 129 - protein, 298 aa, Chlamydia; identical to SEQ ID NO: 123

SEQ ID NO: 130 - DNA, 897 bp, Chlamydia
atggctgctatatgtggacgtttagggtctggtacagggaatgctctaaaagctttttttacacagcccagcaataaaatggcaagggtagtaaataagacgaagggaatggataagactgttaaggtcgccaagtctgctgccgaattgaccgcaaatattttggaacaagctggaggcgcgggctcttccgcacacattacagcttcccaagtgtccaaaggattaggggatgcgagaactgttctcgctttagggaatgcctttaacggagcgttgccaggaacagttcaaagtgcgcaaagcttcttctcttacatgaaagctgctagtcagaaaccgcaagaaggggatgaggggctcgtagcagatctttgtgtgtctcataagcgcagagcggctgcggctgtctgtagcttcatcggaggaattacctacctcgcgacattcggagctatccgtccgattctgtttgtcaacaaaatgctggcgcaaccgtttctttcttcccaaactaaagcaaatatgggatcttctgttagctatattatggcggctaaccatgcagcgtttgtggtgggttctggactcgctatcagtgcggaaagagcagattgcgaagcccgctgcgctcgtattgcgagagaagagtcgtcactcgaattgtcgggagaggaaaatgcttgcgagaggggagtcgctggagagaaagccaagacgttcacgcgcatcaagtatgcactcctcactatgctcgagaagtttttggaatgcgttgccgacgttttcaaattggtgccgttgcctattacaatgggtattcgtgcaattgtggctgcgggatgtacgttcacttctgcagttattggattgtggactttctgcaacagagtataa

SEQ ID NO: 131 - protein, 298 aa, Chlamydia
MAAICGRLGSGTGNALKAFFTQPSNKMARVVNKTKGMDKTVKVAKSAAELTANILEQAGGAGSSAHITASQVSKGLGDARTVLALGNAFNGALPGTVQSAQSFFSYMKAASQKPQEGDEGLVADLCVSHKRRAAAAVCSFIGGITYLATFGAIRPILFVNKMLAQPFLSSQTKANMGSSVSYIMAANHAAFVVGSGLAISAERADCEARCARIAREESSLELSGEENACERGVAGEKAKTFTRIKYALLTMLEKFLECVADVFKLVPLPITMGIRAIVAAGCTFTSAVIGLWTFCNRV

SEQ ID NO: 132 - DNA, 897 bp, Chlamydia
atggctgctatatgcggacgtttagggtctggtacagggaatgctctaaaagctttttttacacagcccagcaataaaatggcaagggtagtaaataagacgaagggaatggataagactgttaaggtcgccaagtctgctgccgaattgaccgcaaatattttggaacaagctggaggcgcgggctcttccgcacacattacagcttcccaagtgtccaaaggattaggggatgcgagaactgttctcgctttagggaatgcctttaacggagcgttgccaggaacagttcaaagtgcgcaaagcttcttctcttacatgaaagctgctagtcagaaaccgcaagaaggggatgaggggctcgtagcagatctttgtgtgtctcataagcgcagagcggctgcggctgtctgtagcttcatcggaggaattacctacctcgcgacattcggagctatccgtccgattctgtttgtcaacaaaatgctggcgcaaccgtttctttcttcccaaactaaagcaaatatgggatcttctgttagctatattatggcggctaaccatgcagcgtttgtggtgggttctggactcgctatcagtgcggaaagagcagattgcgaagcccgctgcgctcgtattgcgagagaagagtcgtcactcgaattgtcgggagaggaaaatgcttgtgagaggagagtcgctggagagaaagccaagacgttcacgcgcatcaagtatgcactcctcactatgctcgagaagtttttggaatgcgttgccgacgttttcaaattggtgccgttgcctattacaatgggtattcgtgcaattgtggctgcgggatgtacgttcacttctgcagttattggattgtggactttctgcaacagagtataa

SEQ ID NO: 133 - protein, 298 aa, Chlamydia
MAAICGRLGSGTGNALKAFFTQPSNKMARVVNKTKGMDKTVKVAKSAAELTANILEQAGGAGSSAHITASQVSKGLGDARTVLALGNAFNGALPGTVQSAQSFFSYMKAASQKPQEGDEGLVADLCVSHKRRAAAAVCSFIGGITYLATFGAIRPILFVNKMLAQPFLSSQTKANMGSSVSYIMAANHAAFVVGSGLAISAERADCEARCARIAREESSLELSGEENACERRVAGEKAKTFTRIKYALLTMLEKFLECVADVFKLVPLPITMGIRAIVAAGCTFTSAVIGLWTFCNRV

SEQ ID NO: 134 - DNA, 897 bp, Chlamydia
atggcttctatatgcggacgtttagggtctggtacagggaatgctctaaaagctttttttacacagcccaacaataaaatggcaagggtagtaaataagacgaagggaatggataagactattaaggttgccaagtctgctgccgaattgaccgcaaatattttggaacaagctggaggcgcgggctcttccgcacacattacagcttcccaagtgtccaaaggattaggggatgcgagaactgttgtcgctttagggaatgcctttaacggagcgttgccaggaacagttcaaagtgcgcaaagcttcttctctcacatgaaagctgctagtcagaaaacgcaagaaggggatgaggggctcacagcagatctttgtgtgtctcataagcgcagagcggctgcggctgtctgtagcatcatcggaggaattacctacctcgcgacattcggagctatccgtccgattctgtttgtcaacaaaatgctggcaaaaccgtttctttcttcccaaactaaagcaaatatgggatcttctgttagctatattatggcggctaaccatgcagcgtctgtggtgggtgctggactcgctatcagtgcggaaagagcagattgcgaagcccgctgcgctcgtattgcgagagaagagtcgttactcgaaatgccgggagaggaaaatgcttgcgagaagaaagtcgctggagagaaagccaagacgttcacgcgcatcaagtatgcactcctcactatgctcgagaagtttttggaatgcgttgccgacgttttcaaattggtgccgctgcctattacaatgggtattcgtgcgattgtggctgctggatgtacgttcacttctgcaattattggattgtgcactttctgcgccagagcataa

SEQ ID NO: 135 - protein, 298 aa, Chlamydia
MASICGRLGSGTGNALKAFFTQPNNKMARVVNKTKGMDKTIKVAKSAAELTANILEQAGGAGSSAHITASQVSKGLGDARTVVALGNAFNGALPGTVQSAQSFFSHMKAASQKTQEGDEGLTADLCVSHKRRAAAAVCSIIGGITYLATFGAIRPILFVNKMLAKPFLSSQTKANMGSSVSYIMAANHAASVVGAGLAISAERADCEARCARIAREESLLEMPGEENACEKKVAGEKAKTFTRIKYALLTMLEKFLECVADVFKLVPLPITMGIRAIVAAGCTFTSAIIGLCTFCARA

SEQ ID NO: 136 - DNA, 882 bp, Chlamydia
atggcttctgtatgtgggcgattaagtgctggggtggggaacagatttaacgcatttttcacgcgtcccggtaacaagctatcacggtttgtaaatagcgcaaaaggattagacagatcaataaaggttgggaagtctgctgctgaattaacggcgagtattttagagcaaactgggggggcagggactgatgcacatgttacggcggccaaggtgtctaaagcacttggggacgcgcgaacagtaatggctctagggaatgtcttcaatgggtctgtgccagcaaccattcaaagtgcgcgaagctgtctcgcccatttacgagcggccggcaaagaagaagaaacatgctccaaggtgaaagatctctgtgtttctcatagacgaagagctgcggctgaggcttgtaatgttattggaggagcaacttatattacaactttcggagcgattcgtccgacattactcgttaacaagcttcttgccaaaccattcctttcctcccaagccaaagaagggttgggagcttctgttggttatatcatggcagcgaaccatgcggcatctgtgcttgggtctgctttaagtattagcgcagaaagagcagactgtgaagagcggtgtgatcgcattcgatgtagtgaggatggtgaaatttgcgaaggcaataaattaacagctatttcggaagagaaggctagatcatggactctcattaagtacagattccttactatgatagaaaaactatttgagatggtggcggatatcttcaagttaattcctttgccaatttcgcatggaattcgtgctattgttgctgcgggatgtacgttgacttctgcagttattggcttaggtactttttggtctagagcataa

SEQ ID NO: 137 - protein, 293 aa, Chlamydia
MASVCGRLSAGVGNRFNAFFTRPGNKLSRFVNSAKGLDRSIKVGKSAAELTASILEQTGGAGTDAHVTAAKVSKALGDARTVMALGNVFNGSVPATIQSARSCLAHLRAAGKEEETCSKVKDLCVSHRRRAAAEACNVIGGATYITTFGAIRPTLLVNKLLAKPFLSSQAKEGLGASVGYIMAANHAASVLGSALSISAERADCEERCDRIRCSEDGEICEGNKLTAISEEKARSWTLIKYRFLTMIEKLFEMVADIFKLIPLPISHGIRAIVAAGCTLTSAVIGLGTFWSRA

SEQ ID NO: 138 - protein, 16 aa, Artificial Sequence
  Made in a lab
DLCVSHKRRAAAAVCS

SEQ ID NO: 139 - protein, 16 aa, Artificial Sequence
  Made in a lab
RAAAAVCSFIGGITYL

SEQ ID NO: 140 - protein, 18 aa, Artificial Sequence
  Made in a lab
CSFIGGITYLATFGAIRP

SEQ ID NO: 141 - protein, 18 aa, Artificial Sequence
  Made in a lab
YLATFGAIRPILFVNKML

SEQ ID NO: 142 - protein, 18 aa, Artificial Sequence
  Made in a lab
RPILFVNKMLAQPFLSSQ

SEQ ID NO: 143 - protein, 17 aa, Artificial Sequence
  Made in a lab
MLAQPFLSSQTKANMGS

SEQ ID NO: 144 - protein, 10 aa, Artificial Sequence
  Made in a lab
CSFIGGITYL

SEQ ID NO: 145 - protein, 9 aa, Artificial Sequence
  Made in a lab
SFIGGITYL

SEQ ID NO: 146 - protein, 8 aa, Artificial Sequence
  Made in a lab
FIGGITYL

SEQ ID NO: 147 - protein, 9 aa, Artificial Sequence
  Made in a lab
CSFIGGITY

SEQ ID NO: 148 - protein, 8 aa, Artificial Sequence
  Made in a lab
CSFIGGIT

SEQ ID NO: 149 - protein, 10 aa, Artificial Sequence
  Made in a lab
CSIIGGITYL

SEQ ID NO: 150 - protein, 10 aa, Artificial Sequence
  Made in a lab
CGFIGGITYL

SEQ ID NO: 151 - protein, 9 aa, Artificial Sequence
  Made in a lab
GFIGGITYL

SEQ ID NO: 152 - protein, 20 aa, Artificial Sequence
  Made in a lab
QIFVCLISAERLRLRLSVAS

SEQ ID NO: 153 - protein, 20 aa, Artificial Sequence
  Made in a lab
ERLRLRLSVASSEELPTSRH

SEQ ID NO: 154 - protein, 20 aa, Artificial Sequence
  Made in a lab
ASSEELPTSRHSELSVRFCL

SEQ ID NO: 155 - protein, 20 aa, Artificial Sequence
  Made in a lab
RHSELSVRFCLSTKCWRNRF

SEQ ID NO: 156 - protein, 20 aa, Artificial Sequence
  Made in a lab
LSTKCWRNRFFLPKLKQIWD

SEQ ID NO: 157 - protein, 53 aa, Artificial Sequence
  Made in a lab
IFVCLISAERLRLSVASSEELPTSRHSELSVRFCLSTKCWRNRFFLPKLKQIW

SEQ ID NO: 158 - protein, 52 aa, Artificial Sequence
  Made in a lab
LCVSHKRRAAAAVCSFIGGITYLATFGAIRPILFVNKMLAQPFLSSQIKANM

SEQ ID NO: 159 - DNA, 24 bp, Chlamydia
ttttgaagcaggtaggtgaatatg

SEQ ID NO: 160 - DNA, 24 bp, Chlamydia
ttaagaaatttaaaaaatccctta

SEQ ID NO: 161 - DNA, 24 bp, Chlamydia
ggtataatatctctctaaattttg

SEQ ID NO: 162 - DNA, 19 bp, Chlamydia
agataaaaaaggctgtttc

SEQ ID NO: 163 - DNA, 24 bp, Chlamydia
ttttgaagcaggtaggtgaatatg

SEQ ID NO: 164 - DNA, 29 bp, Chlamydia
tttacaataagaaaagctaagcactttgt

SEQ ID NO: 165 - DNA, 20 bp, Chlamydia
ccttacacagtcctgctgac

SEQ ID NO: 166 - DNA, 20 bp, Chlamydia
gtttccgggccctcacattg

SEQ ID NO: 167 - protein, 9 aa, Artificial Sequence
  Made in a lab
SFIGGITYL

SEQ ID NO: 168 - protein, 9 aa, Artificial Sequence
  Made in a lab
SIIGGITYL

SEQ ID NO: 169 - DNA, 2643 bp, Chlamydia
gcaatcatgcgacctgatcatatgaacttctgttgtctatgtgctgctattttgtcatccacagcggtcctctttggccaggatcccttaggtgaaaccgccctcctcactaaaaatcctaatcatgtcgtctgtacattttttgaggactgtaccatggagagcctctttcctgctctttgtgctcatgcatcacaagacgatcctttgtatgtacttggaaattcctactgttggttcgtatctaaactccatatcacggaccccaaagaggctctttttaaagaaaaaggagatctttccattcaaaactttcgcttcctttccttcacagattgctcttccaaggaaagctctccttctattattcatcaaaagaatggtcagttatccttgcgcaataatggtagcatgagtttctgtcgaaatcatgctgaaggctctggaggagccatctctgcggatgccttttctctacagcacaactatcttttcacagcttttgaagagaattcttctaaaggaaatggcggagccattcaggctcaaaccttctctttatctagaaatgtgtcgcctatttctttcgcccgtaatcgtgcggatttaaatggcggcgctatttgctgtagtaatcttatttgttcagggaatgtaaaccctctctttttcactggaaactccgccacgaatggaggcgctatttgttgtatcagcgatctaaacacctcagaaaaaggctctctctctcttgcttgtaaccaagaaacgctatttgcaagcaattctgctaaagaaaaaggcggggctatttatgccaagcacatggtattgcgttataacggtcctgtttccttcattaacaacagcgctaaaataggtggagctatcgccatccagtccggagggagtctctctatccttgcaggtgaaggatctgttctgttccagaataactcccaacgcacctccgaccaaggtctagtaagaaacgccatctacttaragaaagatgcgattctttcttccttagaagctcgcaacggagatattcttttctttgatcctattgtacaagaaagtagcagcaaagaatcgcctcttccctcctctttgcaagccagcgtgacttctcccaccccagccaccgcatctcctttagttattcagacaagtgcaaaccgttcagtgattttctcgagcgaacgtctttctgaagaagaaaaaactcctgataacctcacttcccaactacagcagcctatcgaactgaaatccggacgcttagttttaaaagatcgcgctgtcctttccgcgccttctctctctcaggatcctcaagctctcctcattatggaagcgggaacttctttaaaaacttcctctgatttgaagttagctacgctaagtattccccttcattccttagatactgaaaaaagcgtaactatccacgcccctaatctttctatccaaaagatcttcctctctaactctggagatgagaatttttatgaaaatgtagagcttctcagtaaagagcaaaacaatattcctctccttactctccctaaagagcaatctcatttacatcttcctgatgggaacctctcttctcactttggatatcaaggagattggactttttcttggaaagattctgatgaagggcattctctgattgctaattggacgcctaaaaactatgtgcctcatccagaacgtcaatctacactcgttgcgaacactctttggaacacctattccgatatgcaagctgtgcagtcgatgattaatacaacagcgcacggaggagcctatctatttggaacgtggggatctgctgtttctaatttattctatgttcacgacagctctgggaaacctatcgataattggcatcatagaagccttggctacctattcggtatcagtactcacagtttagatgaccattctttctgcttggctgcaggacaattactcgggaaatcgtccgattcctttattacgtctacagaaacgacctcctatatagctactgtacaagcgcaactcgctacctctctaatgaaaatctctgcacaggcatgctacaatgaaagtatccatgagctaaaaacaaaatatcgctccttctctaaagaaggattcggatcctggcatagcgttgcagtatccggagaagtgtgcgcatcgattcctattgtatccaatggttccggactgttcagctccttctctattttctctaaactgcaaggattttcaggaacacaggacggttttgaggagagttcgggagagattcggtccttttctgccagctctttcagaaatatttcacttcctataggaataacatttgaaaaaaaatcccaaaaaacacgaacctactattactttctaggagcctacatccaagacctgaaacgtgatgtggaatcgggacctgtagtgttactcaaaaatgccgtctcctgggatgctcctatggcgaacttggattcacgagcctacatgttccggcttacgaatcaaagagctctacacagacttcagacgctgttaaatgtgtcttgtgtgctgcgtgggcaaagccatagttactccctggatctggggaccacttacaggttctag

SEQ ID NO: 170 - DNA, 2949 bp, Chlamydia
atgattcctcaaggaatttacgatggggagacgttaactgtatcatttccctatactgttataggagatccgagtgggactactgttttttctgcaggagagttaacattaaaaaatcttgacaattctattgcagctttgcctttaagttgttttgggaacttattagggagttttactgttttagggagaggacactcgttgactttcgagaacatacggacttctacaaatggggcagctctaagtaatagcgctgctgatggactgtttactattgagggttttaaagaattatccttttccaattgcaattcattacttgccgtactgcctgctgcaacgactaataagggtagccagactccgacgacaacatctacaccgtctaatggtactatttattctaaaacagatcttttgttactcaataatgagaagttctcattctatagtaatttagtctctggagatgggggagctatagatgctaagagcttaacggttcaaggaattagcaagctttgtgtcttccaagaaaatactgctcaagctgatgggggagcttgtcaagtagtcaccagtttctctgctatggctaacgaggctcctattgcctttgtagcgaatgttgcaggagtaagagggggagggattgctgctgttcaggatgggcagcagggagtgtcatcatctacttcaacagaagatccagtagtaagtttttccagaaatactgcggtagagtttgatgggaacgtagcccgagtaggaggagggatttactcctacgggaacgttgctttcctgaataatggaaaaaccttgtttctcaacaatgttgcttctcctgtttacattgctgctaagcaaccaacaagtggacaggcttctaatacgagtaataattacggagatggaggagctatcttctgtaagaatggtgcgcaagcaggatccaataactctggatcagtttcctttgatggagagggagtagttttctttagtagcaatgtagctgctgggaaagggggagctatttatgccaaaaagctctcggttgctaactgtggccctgtacaatttttaaggaatatcgctaatgatggtggagcgatttatttaggagaatctggagagctcagtttatctgctgattatggagatattattttcgatgggaatcttaaaagaacagccaaagagaatgctgccgatgttaatggcgtaactgtgtcctcacaagccatttcgatgggatcgggagggaaaataacgacattaagagctaaagcagggcatcagattctctttaatgatcccatcgagatggcaaacggaaataaccagccagcgcagtcttccaaacttctaaaaattaacgatggtgaaggatacacaggggatattgtttttgctaatggaagcagtactttgtaccaaaatgttacgatagagcaaggaaggattgttcttcgtgaaaaggcaaaattatcagtgaattctctaagtcagacaggtgggagtctgtatatggaagctgggagtacattggattttgtaactccacaaccaccacaacagcctcctgccgctaatcagttgatcacgctttccaatctgcatttgtctctttcttctttgttagcaaacaatgcagttacgaatcctcctaccaatcctccagcgcaagattctcatcctgcagtcattggtagcacaactgctggttctgttacaattagtgggcctatcttttttgaggatttggatgatacagcttatgataggtatgattggctaggttctaatcaaaaaatcaatgtcctgaaattacagttagggactaagcccccagctaatgccccatcagatttgactctagggaatgagatgcctaagtatggctatcaaggaagctggaagcttgcgtgggatcctaatacagcaaataatggtccttatactctgaaagctacatggactaaaactgggtataatcctgggcctgagcgagtagcttctttggttccaaatagtttatggggatccattttagatatacgatctgcgcattcagcaattcaagcaagtgtggatgggcgctcttattgtcgaggattatgggtttctggagtttcgaatttcttctatcatgaccgcgatgctttaggtcagggatatcggtatattagtgggggttattccttaggagcaaactcctactttggatcatcgatgtttggtctagcatttaccgaagtatttggtagatctaaagattatgtagtgtgtcgttccaatcatcatgcttgcataggatccgtttatctatctacccaacaagctttatgtggatcctatttgttcggagatgcgtttatccgtgctagctacgggtttgggaatcagcatatgaaaacctcatatacatttgcagaggagagcgatgttcgttgggataataactgtctggctggagagattggagcgggattaccgattgtgattactccatctaagctctatttgaatgagttgcgtcctttcgtgcaagctgagttttcttatgccgatcatgaatcttttacagaggaaggcgatcaagctcgggcattcaagagcggacatctcctaaatctatcagttcctgttggagtgaagtttgatcgatgttctagtacacatcctaataaatatagctttatggcggcttatatctgtgatgcttatcgcaccatctctggtactgagacaacgctcctatcccatcaagagacatggacaacagatgcctttcatttagcaagacatggagttgtggttagaggatctatgtatgcttctctaacaagtaatatagaagtatatggccatggaagatatgagtatcgagatgcttctcgaggctatggtttgagtgcaggmagtaaagtcyggttctaa

SEQ ID NO: 171 - DNA, 2895 bp, Chlamydia
atgaaaaaagcgtttttctttttccttatcggaaactccctatcaggactagctagagaggttccttctagaatctttcttatgcccaactcagttccagatcctacgaaagagtcgctatcaaataaaattagtttgacaggagacactcacaatctcactaactgctatctcgataacctacgctacatactggctattctacaaaaaactcccaatgaaggagctgctgtcacaataacagattacctaagcttttttgatacacaaaaagaaggtatttattttgcaaaaaatctcacccctgaaagtggtggtgcgattggttatgcgagtcccaattctcctaccgtggagattcgtgatacaataggtcctgtaatctttgaaaataatacttgttgcagactatttacatggagaaatccttatgctgctgataaaataagagaaggcggagccattcatgctcaaaatctttacataaatcataatcatgatgtggtcggatttatgaagaacttttcttatgtccaaggaggagccattagtaccgctaatacctttgttgtgagcgagaatcagtcttgttttctctttatggacaacatctgtattcaaactaatacagcaggaaaaggtggcgctatctatgctggaacgagcaattcttttgagagtaataactgcgatctcttcttcatcaataacgcctgttgtgcaggaggagcgatcttctcccctatctgttctctaacaggaaatcgtggtaacatcgttttctataacaatcgctgctttaaaaatgtagaaacagcttcttcagaagcttctgatggaggagcaattaaagtaactactcgcctagatgttacaggcaatcgtggtaggatcttttttagtgacaatatcacaaaaaattatggcggagctatttacgctcctgtagttaccctagtggataatggccctacctactttataaacaatatcgccaataataaggggggcgctatctatatagacggaaccagtaactccaaaatttctgccgaccgccatgctattatttttaatgaaaatattgtgactaatgtaactaatgcaaatggtaccagtacgtcagctaatcctcctagaagaaatgcaataacagtagcaagctcctctggtgaaattctattaggagcagggagtagccaaaatttaattttttatgatcctattgaagttagcaatgcaggggtctctgtgtccttcaataaggaagctgatcaaacaggctctgtagtattttcaggagctactgttaattctgcagattttcatcaacgcaatttacaaacaaaaacacctgcaccccttactctcagtaatggttttctatgtatcgaagatcatgctcagcttacagtgaatcgattcacacaaactgggggtgttgtttctcttgggaatggagcagttctgagttgctataaaaatggtacaggagattctgctagcaatgcctctataacactgaagcatattggattgaatctttcttccattctgaaaagtggtgctgagattcctttattgtgggtagagcctacaaataacagcaataactatacagcagatactgcagctaccttttcattaagtgatgtaaaactctcactcattgatgactacgggaactctccttatgaatccacagatctgacccatgctctgtcatcacagcctatgctatctatttctgaagctagcgataaccagctacaatcagaaaatatagatttttcgggactaaatgtccctcattatggatggcaaggactttggacttggggctgggcaaaaactcaagatccagaaccagcatcttcagcaacaatcactgatccacaaaaagccaatagatttcatagaaccttactactaacatggcttcctgccgggtatgttcctagcccaaaacacagaagtcccctcatagctaacaccttatgggggaatatgctgcttgcaacagaaagcttaaaaaatagtgcagagctgacacctagtggtcatcctttctggggaattacaggaggaggactaggcatgatggtttaccaagatcctcgagaaaatcatcctggattccatatgcgctcttccggatactctgcggggatgatagcagggcagacacacaccttctcattgaaattcagtcagacctacaccaaactcaatgagcgttacgcaaaaaacaacgtatcttctaaaaattactcatgccaaggagaaatgctcttctcattgcaagaaggtttcttgctgactaaattagttgggctttacagctatggagaccataactgtcaccatttctatactcaaggagaaaatctaacatctcaagggacgttccgcagtcaaacgatgggaggtgctgtcttttttgatctccctatgaaaccctttggatcaacgcatatactgacagctccctttttaggtgctcttggtatttattctagcctgtctcactttactgaggtgggagcctatccgcgaagcttttctacaaagactcctttgatcaatgtcctagtccctattggagttaaaggtagctttatgaatgctacccacagacctcaagcctggactgtagaattggcataccaacccgttctgtatagacaagaaccagggatcgcgacccagctcctagccagtaaaggtatttggtttggtagtggaagcccctcatcgcgtcatgccatgtcctataaaatctcacagcaaacacaacctttgagttggttaactctccatttccagtatcatggattctactcctcttcaaccttctgtaattatctcaatggggaaattgctctgcgattctag

SEQ ID NO: 172 - DNA, 4593 bp, Chlamydia
atgagttccgagaaagatataaaaagcacctgttctaagttttctttgtctgtagtagcagctatccttgcctctgttagcgggttagctagttgcgtagatcttcatgctggaggacagtctgtaaatgagctggtatatgtaggccctcaagcggttttattgttagaccaaattcgagatctattcgttgggtctaaagatagtcaggctgaaggacagtataggttaattgtaggagatccaagttctttccaagagaaagatgcagatactcttcccgggaaggtagagcaaagtactttgttctcagtaaccaatcccgtggttttccaaggtgtggaccaacaggatcaagtctcttcccaagggttaatttgtagttttacgagcagcaaccttgattctccccgtgacggagaatcttttttaggtattgcttttgttggggatagtagtaaggctggaatcacattaactgacgtgaaagcttctttgtctggagcggctttatattctacagaagatcttatctttgaaaagattaagggtggattggaatttgcatcatgttcttctctagaacaggggggagcttgtgcagctcaaagtattttgattcatgattgtcaaggattgcaggttaaacactgtactacagccgtgaatgctgaggggtctagtgcgaatgatcatcttggatttggaggaggcgctttctttgttacgggttctctttctggagagaaaagtctctatatgcctgcaggagatatggtagttgcgaattgtgatggggctatatcttttgaaggaaacagcgcgaactttgctaatggaggagcgattgctgcctctgggaaagtgctttttgtcgctaatgataaaaagacttcttttatagagaaccgagctttgtctggaggagcgattgcagcctcttctgatattgcctttcaaaactgcgcagaactagttttcaaaggcaattgtgcaattggaacagaggataaaggttctttaggtggaggggctatatcttctctaggcaccgttcttttgcaagggaatcacgggataacttgtgataagaatgagtctgcttcgcaaggaggcgccatttttggcaaaaattgtcagatttctgacaacgaggggccagtggttttcagagatagtacagcttgcttaggaggaggcgctattgcagctcaagaaattgtttctattcagaacaatcaggctgggatttccttcgagggaggtaaggctagtttcggaggaggtattgcgtgtggatctttttcttccgcaggcggtgcttctgttttagggactattgatatttcgaagaatttaggcgcgatttcgttctctcgtactttatgtacgacctcagatttaggacaaatggagtaccagggaggaggagctctatttggtgaaaatatttctctttctgagaatgctggtgtgctcacctttaaagacaacattgtgaagacttttgcttcgaatgggaaaattctgggaggaggagcgattttagctactggtaaggtggaaattaccaataattccggaggaatttcttttacaggaaatgcgagagctccacaagctcttccaactcaagaggagtttcctttattcagcaaaaaagaagggcgaccactctcttcaggatattctgggggaggagcgattttaggaagagaagtagctattctccacaacgctgcagtagtatttgagcaaaatcgtttgcagtgcagcgaagaagaagcgacattattaggttgttgtggaggaggcgctgttcatgggatggatagcacttcgattgttggcaactcttcagtaagatttggtaataattacgcaatgggacaaggagtctcaggaggagctcttttatctaaaacagtgcagttagctggaaatggaagcgtcgatttttctcgaaatattgctagtttgggaggaggagctcttcaagcttctgaaggaaattgtgagctagttgataacggctatgtgctattcagagataatcgagggagggtttatgggggtgctatttcttgcttacgtggagatgtagtcatttctggaaacaagggtagagttgaatttaaagacaacatagcaacacgtctttatgtggaagaaactgtagaaaaggttgaagaggtagagccagctcctgagcaaaaagacaataatgagctttctttcttagggagtgtagaacagagttttattactgcagctaatcaagctcttttcgcatctgaagatggggatttatcacctgagtcatccatttcttctgaagaacttgcgaaaagaagagagtgtgctggaggagctatttttgcaaaacgggttcgtattgtagataaccaagaggccgttgtattctcgaataacttctctgatatttatggcggcgccatttttacaggttctcttcgagaagaggataagttagatgggcaaatccctgaagtcttgatctcaggcaatgcaggggatgttgttttttccggaaattcctcgaagcgtgatgagcatcttcctcatacaggtgggggagccatttgtactcaaaatttgacgatttctcagaatacagggaatgttctgttttataacaacgtggcctgttcgggaggagctgttcgtatagaggatcatggtaatgttcttttagaagcttttggaggagatattgtttttaaaggaaattcttctttcagagcacaaggatccgatgctatctattttgcaggtaaagaatcgcatattacagccctgaatgctacggaaggacatgctattgttttccacgacgcattagtttttgaaaatctaaaagaaaggaaatctgctgaagtattgttaatcaatagtcgagaaaatccaggttacactggatctattcgatttttagaagcagaaagtaaagttcctcaatgtattcatgtacaacaaggaagccttgagttgctaaatggagctacattatgtagttatggttttaaacaagatgctggagctaagttggtattggctgctggatctaaactgaagattttagattcaggaactcctgtacaagggcatgctatcagtaaacctgaagcagaaatcgagtcatcttctgaaccagagggtgcacattctctttggattgcgaagaatgctcaaacaacagttcctatggttgatatccatactatttctgtagatttagcctccttctcttctagtcaacaggaggggacagtagaagctcctcaggttattgttcctggaggaagttatgttcgatctggagagcttaatttggagttagttaacacaacaggtactggttatgaaaatcatgctttgttgaagaatgaggctaaagttccattgatgtctttcgttgcttctagtgatgaagcttcagccgaaatcagtaacttgtcggtttctgatttacagattcatgtagcaactccagagattgaagaagacacatacggccatatgggagattggtctgaggctaaaattcaagatggaactcttgtcattaattggaatcctactggatatcgattagatcctcaaaaagcaggggctttagtatttaatgcattatgggaagaaggggctgtcttgtctgctctgaaaaatgcacgctttgctcataatctcactgctcagcgtatggaattcgattattctacaaatgtgtggggattcgcctttggtggtttccgaactctatctgcagagaatctggttgctattgatggatacaaaggagcttatggtggtgcttctgctggagtcgatattcaattgatggaagattttgttctaggagttagtggagctgctttcctaggtaaaatggatagtcagaagtttgatgcggaggtttctcggaagggagttgttggttctgtatatacaggatttttagctggatcctggttcttcaaaggacaatatagccttggagaaacacagaacgatatgaaaacgcgttatggagtactaggagagtcgagtgcttcttggacatctcgaggagtactggcagatgctttagttgaataccgaagtttagttggtcctgtgagacctactttttatgctttgcatttcaatccttatgtcgaagtatcttatgcttctatgaaattccctggctttacagaacaaggaagagaagcgcgttcttttgaagacgcttcccttaccaatatcaccattcctttagggatgaagtttgaattggcgttcataaaaggacagttttcagaggtgaactctttgggaataagttatgcatgggaagcttatcgaaaagtagaaggaggcgcggtgcagcttttagaagctgggtttgattgggagggagctccaatggatcttcctagacaggagctgcgtgtcgctctggaaaataatacggaatggagttcttacttcagcacagtcttaggattaacagctttttgtggaggatttacttctacagatagtaaactaggatatgaggcgaatactggattgcgattgatcttttaa

SEQ ID NO: 173 - DNA, 5331 bp, Chlamydia
gcaatcatgaaatttatgtcagctactgctgtatttgctgcagtactctcctccgttactgaggcgagctcgatccaagatcaaataaagaataccgactgcaatgttagcaaagtaggatattcaacttctcaagcatttactgatatgatgctagcagacaacacagagtatcgagctgctgatagtgtttcattctatgacttttcgacatcttccggattacctagaaaacatcttagtagtagtagtgaagcttctccaacgacagaaggagtgtcttcatcttcatctggagaaaatactgagaattcacaagattcagctccctcttctggagaaactgataagaaaacagaagaagaactagacaatggcggaatcatttatgctagagagaaactaactatctcagaatctcaggactctctctctaatccaagcatagaactccatgacaatagttttttcttcggagaaggtgaagttatctttgatcacagagttgccctcaaaaacggaggagctatttatggagagaaagaggtagtctttgaaaacataaaatctctactagtagaagtaaatatctcggtcgagaaagggggtagcgtctatgcaaaagaacgagtatctttagaaaatgttaccgaagcaaccttctcctccaatggtggggaacaaggtggtggtggaatctattcagaacaagatatgttaatcagtgattgcaacaatgtacatttccaagggaatgctgcaggagcaacagcagtaaaacaatgtctggatgaagaaatgatcgtattgctcacagaatgcgttgatagcttatccgaagatacactggatagcactccagaaacggaacagactaagtcaaatggaaatcaagatggttcgtctgaaacaaaagatacacaagtatcagaatcaccagaatcaactcctagccccgacgatgttttaggtaaaggtggtggtatctatacagaaaaatctttgaccatcactggaattacagggactatagattttgtcagtaacatagctaccgattctggagcaggtgtattcactaaagaaaacttgtcttgcaccaacacgaatagcctacagtttttgaaaaactcggcaggtcaacatggaggaggagcctacgttactcaaaccatgtctgttactaatacaactagtgaaagtataactactccccctctcgtaggagaagtgattttctctgaaaatacagctaaagggcacggtggtggtatctgcactaacaaactttctttatctaatttaaaaacggtgactctcactaaaaactctgcaaaggagtctggaggagctatttttacagatctagcgtctataccaacaacagataccccagagtcttctaccccctcttcctcctcgcctgcaagcactcccgaagtagttgcttctgctaaaataaatcgattctttgcctctacggcagaaccggcagccccttctctaacagaggctgagtctgatcaaacggatcaaacagaaacttctgatactaatagcgatatagacgtgtcgattgagaacattttgaatgtcgctatcaatcaaaacacttctgcgaaaaaaggaggggctatttacgggaaaaaagctaaactttcccgtattaacaatcttgaactttcagggaattcatcccaggatgtaggaggaggtctctgtttaactgaaagcgtagaatttgatgcaattggatcgctcttatcccactataactctgctgctaaagaaggtggggttattcattctaaaacggttactctatctaacctcaagtctaccttcacttttgcagataacactgttaaagcaatagtagaaagcactcctgaagctccagaagagattcctccagtagaaggagaagagtctacagcaacagaaaatccgaattctaatacagaaggaagttcggctaacactaaccttgaaggatctcaaggggatactgctgatacagggactggtgttgttaacaatgagtctcaagacacatcagatactggaaacgctgaatctggagaacaactacaagattctacacaatctaatgaagaaaatacccttcccaatagtagtattgatcaatctaacgaaaacacagacgaatcatctgatagccacactgaggaaataactgacgagagtgtctcatcgtcctctaaaagtggatcatctactcctcaagatggaggagcagcttcttcaggggctccctcaggagatcaatctatctctgcaaacgcttgtttagctaaaagctatgctgcgagtactgatagctcccctgtatctaattcttcaggttcagacgttactgcatcttctgataatccagactcttcctcatctggagatagcgctggagactctgaaggaccgactgagccagaagctggttctacaacagaaactcctactttaataggaggaggtgctatctatggagaaactgttaagattgagaacttctctggccaaggaatattttctggaaacaaagctatcgataacaccacagaaggctcctcttccaaatctaacgtcctcggaggtgcggtctatgctaaaacattgtttaatctcgatagcgggagctctagacgaactgtcaccttctccgggaatactgtctcttctcaatctacaacaggtcaggttgctggaggagctatctactctcctactgtaaccattgctactcctgtagtattttctaaaaactctgcaacaaacaatgctaataacgctacagatactcagagaaaagacacctttggaggagctatcggagctacttctgctgtttctctatcaggaggggctcatttcttagaaaacgttgctgacctcggatctgctattgggttggtgccagacacacaaaatacagaaacagtgaaattagagtctggctcctactactttgaaaaaaataaagctttaaaacgagctactatttacgcacctgtcgtttccattaaagcctatactgcgacatttaaccaaaacagatctctagaagaaggaagcgcgatttactttacaaaagaagcatctattgagtctttaggctctgttctcttcacaggaaacttagtaaccccaacgctaagcacaactacagaaggcacaccagccacaacctcaggagatgtaacaaaatatggtgctgctatctttggacaaatagcaagctcaaacggatctcagacggataaccttcccctgaaactcattgcttcaggaggaaatatttgtttccgaaacaatgaataccgtcctacttcttctgataccggaacctctactttctgtagtattgcgggagatgttaaattaaccatgcaagctgcaaaagggaaaacgatcagtttctttgatgcaatccggacctctactaagaaaacaggtacacaggcaactgcctacgatactctcgatattaataaatctgaggattcagaaactgtaaactctgcgtttacaggaacgattctgttctcctctgaattacatgaaaataaatcctatattccacaaaacgtagttctacacagtggatctcttgtattgaagccaaataccgagcttcatgtcatttcttttgagcagaaagaaggctcttctctcgttatgacacctggatctgttctttcgaaccagactgttgctgatggagctttggtcataaataacatgaccattgatttatccagcgtagagaaaaatggtattgctgaaggaaatatctttactcctccagaattgagaatcatagacactactacaagtggaagcggtggaaccccatctacagatagtgaaagtaaccagaatagtgatgataccaaggagcaaaataataatgacgcctcgaatcaaggagaaagcgcgaatggatcgtcttctcctgcagtagctgctgcacacacatctcgtacaagaaactttgccgctgcagctacagccacacctacgacaacaccaacggctacaactacaacaagcaaccaagtaatcctaggaggagaaatcaaactcatcgatcctaatgggaccttcttccagaaccctgcattaagatccgaccaacaaatctccttgttagtgctccctacagactcatcaaaaatgcaagctcagaaaatagtactgacgggtgatattgctcctcagaaaggatatacaggaacactcactctggatcctgatcaactacaaaatggaacgatctcagcgctctggaaatttgactcttatagacaatgggcttatgtacctagagacaatcatttctatgcgaactcgattctgggatctcaaatgtcaatggtcacagtcaaacaaggcttgctcaacgataaaatgaatctagctcgctttgatgaagttagctataacaacctgtggatatcaggactaggaacgatgctatcgcaagtaggaacacctacttctgaagaattcacttattacagcagaggagcttctgttgccttagatgctaaaccagcccatgatgtgattgttggagctgcatttagtaagatgatcgggaaaacaaaatccttgaaaagagagaataactacactcacaaaggatccgaatattcttaccaagcatcggtatacggaggcaaaccattccactttgtaatcaataaaaaaacggaaaaatcgctaccgctattgttacaaggagtcatctcttacggatatatcaaacatgatacagtgactcactatccaacgatccgtgaacgaaaccaaggagaatgggaagacttaggatggctgacagctctccgtgtctcctctgtcttaagaactcctgcacaaggggatactaaacgtatcactgtttacggagaattggaatactccagtatccgtcagaaacaattcacagaaacagaatacgatcctcgttacttcgacaactgcacctatagaaacttagcaattcctatggggttagcattcgaaggagagctctctggtaacgatattttgatgtacaacagattctctgtagcatacatgccatcaatctatcgaaattctccaacatgcaaataccaagtgctctcttcaggagaaggcggagaaattatttgtggagtaccgacaagaaactcagctcgcggagaatacagcacgcagctgtacccgggacctttgtggactctgtatggatcctacacgatagaagcagacgcacatacactagctcatatgatgaactgcggtgctcgtatgacattctaa

SEQ ID NO: 174 - DNA, 5265 bp, Chlamydia
gcaatcatgaaatggctgtcagctactgcggtgtttgctgctgttctcccctcagtttcagggttttgcttcccagaacctaaagaattaaatttctctcgcgtagaaacttcttcctctaccacttttactgaaacaattggagaagctggggcagaatatatcgtctctggtaacgcatctttcacaaaatttaccaacattcctactaccgatacaacaactcccacgaactcaaactcctctagctctagcggagaaactgcttccgtttctgaggatagtgactctacaacaacgactcctgatcctaaaggtggcggcgccttttataacgcgcactccggagttttgtcctttatgacacgatcaggaacagaaggttccttaactctgtctgagataaaaatgactggtgaaggcggtgctatcttctctcaaggagagctgctatttacagatctgacaagtctaaccatccaaaataacttatcccagctatccggaggagcgatttttggaggatctacaatctccctatcagggattactaaagcgactttctcctgcaactctgcagaagttcctgctcctgttaagaaacctacagaacctaaagctcaaacagcaagcgaaacgtcgggttctagtagttctagcggaaatgattcggtgtcttcccccagttccagtagagctgaacccgcagcagctaatcttcaaagtcactttatttgtgctacagctactcctgctgctcaaaccgatacagaaacatcaactccctctcataagccaggatctgggggagctatctatgctaaaggcgaccttactatcgcagactctcaagaggtactattctcaataaataaagctactaaagatggaggagcgatctttgctgagaaagatgtttctttcgagaatattacatcattaaaagtacaaactaacggtgctgaagaaaagggaggagctatctatgctaaaggtgacctctcaattcaatcttctaaacagagtctttttaattctaactacagtaaacaaggtgggggggctctatatgttgaaggaggtataaacttccaagatcttgaagaaattcgcattaagtacaataaagctggaacgttcgaaacaaaaaaaatcactttaccttctttaaaagctcaagcatctgcaggaaatgcagatgcttgggcctcttcctctcctcaatctggttctggagcaactacagtctccgactcaggagactctagctctggctcagactcggatacctcagaaacagttccagtcacagctaaaggcggtgggctttatactgataagaatctttcgattactaacatcacaggaattatcgaaattgcaaataacaaagcgacagatgttggaggtggtgcttacgtaaaaggaacccttacttgtgaaaactctcaccgtctacaatttttgaaaaactcttccgataaacaaggtggaggaatctacggagaagacaacatcaccctatctaatttgacagggaagactctattccaagagaatactgccaaagaagagggcggtggactcttcataaaaggtacagataaagctcttacaatgacaggactggatagtttctgtttaattaataacacatcagaaaaacatggtggtggagcctttgttaccaaagaaatctctcagacttacacctctgatgtggaaacaattccaggaatcacgcctgtacatggtgaaacagtcattactggcaataaatctacaggaggtaatggtggaggcgtgtgtacaaaacgtcttgccttatctaaccttcaaagcatttctatatccgggaattctgcagcagaaaatggtggtggagcccacacatgcccagatagcttcccaacggcggatactgcagaacagcccgcagcagcttctgccgcgacgtctactcccaaatctgccccggtctcaactgctctaagcacaccttcatcttctaccgtctcttcattaaccttactagcagcctcttcacaagcctctcctgcaacctctaataaggaaactcaagatcctaatgctgatacagacttattgatcgattatgtagttgatacgactatcagcaaaaacactgctaagaaaggcggtggaatctatgctaaaaaagccaagatgtcccgcatagaccaactgaatatctctgagaactccgctacagagataggtggaggtatctgctgtaaagaatctttagaactagatgctctagtctccttatctgtaacagagaaccttgttgggaaagaaggtggaggcttacatgctaaaactgtaaatatttctaatctgaaatcaggcttctctttctcgaacaacaaagcaaactcctcatccacaggagtcgcaacaacagcttcagcacctgctgcagctgctgcttccctacaagcagccgcagcagccgcaccatcatctccagcaacaccaacttattcaggtgtagtaggaggagctatctatggagaaaaggttacattctctcaatgtagcgggacttgtcagttctctgggaaccaagctatcgataacaatccctcccaatcatcgttgaacgtacaaggaggagccatctatgccaaaacctctttgtctattggatcttccgatgctggaacctcctatattttctcggggaacagtgtctccactgggaaatctcaaacaacagggcaaatagcgggaggagcgatctactcccctactgttacattgaattgtcctgcgacattctctaacaatacagcctctatagctacaccgaagacttcttctgaagatggatcctcaggaaattctattaaagataccattggaggagccattgcagggacagccattaccctatctggagtctctcgattttcagggaatacggctgatttaggagctgcaataggaactctagctaatgcaaatacacccagtgcaactagcggatctcaaaatagcattacagaaaaaattactttagaaaacggttcttttatttttgaaagaaaccaagctaataaacgtggagcgatttactctcctagcgtttccattaaagggaataatattaccttcaatcaaaatacatccactcatgatggaagcgctatctactttacaaaagatgctacgattgagtctttaggatctgttctttttacaggaaataacgttacagctacacaagctagttctgcaacatctggacaaaatacaaatactgccaactatggggcagccatctttggagatccaggaaccactcaatcgtctcaaacagatgccattttaacccttcttgcttcttctggaaacattacttttagcaacaacagtttacagaataaccaaggtgatactcccgctagcaagttttgtagtattgcaggatacgtcaaactctctctacaagccgctaaagggaagactattagctttttcgattgtgtgcacacctctaccaaaaaaacaggttcaacacaaaacgtttatgaaactttagatattaataaagaagagaacagtaatccatatacaggaactattgtgttctcttctgaattacatgaaaacaaatcttacatcccacagaatgcaatccttcacaacggaactttagttcttaaagagaaaacagaactccacgtagtctcttttgagcagaaagaagggtctaaattaattatggaacccggagctgtgttatctaaccaaaacatagctaacggagctctagctatcaatgggttaacgattgatctttccagtatggggactcctcaagcaggggaaatcttctctcctccagaattacgtatcgttgccacgacctctagtgcatccggaggaagcggggtcagcagtagtataccaacaaatcctaaaaggatttctgcagcagtgccttcaggttctgccgcaactactccaactatgagcgagaacaaagttttcctaacaggagaccttactttaatagatcctaatggaaacttttaccaaaaccctatgttaggaagcgatctagatgtaccactaattaagcttccgactaacacaagtgacgtccaagtctatgatttaactttatctggggatcttttccctcagaaagggtacatgggaacctggacattagattctaatccacaaacagggaaacttcaagccagatggacattcgatacctatcgtcgctgggtatacatacctagggataatcatttttatgcgaactctatcttaggctcccaaaactcaatgattgttgtgaagcaagggcttatcaacaacatgttgaataatgcccgcttcgatgatatcgcttacaataacttctgggtttcaggagtaggaactttcttagctcaacaaggaactcctctttccgaagaattcagttactacagccgcggaacttcagttgccatcgatgccaaacctagacaagattttatcctaggagctgcatttagtaagatagtggggaaaaccaaagccatcaaaaaaatgcataattacttccataagggctctgagtactcttaccaagcttctgtctatggaggtaaattcctgtatttcttgctcaataagcaacatggttgggcacttcctttcctaatacaaggagtcgtgtcctatggacatattaaacatgatacaacaacactttacccttctatccatgaaagaaataaaggagattgggaagatttaggatggttagcggatcttcgtatctctatggatcttaaagaaccttctaaagattcttctaaacggatcactgtctatggggaactcgagtattccagcattcgccagaaacagttcacagaaatcgattacgatccaagacacttcgatgattgtgcttacagaaatctgtcgcttcctgtgggatgcgctgtcgaaggagctatcatgaactgtaatattcttatgtataataagcttgcattagcctacatgccttctatctacagaaataatcctgtctgtaaatatcgggtattgtcttcgaatgaagctggtcaagttatctgcggagtgccaactagaacctctgctagagcagaatacagtactcaactatatcttggtcccttctggactctctacggaaactatactatcgatgtaggcatgtatacgctatcgcaaatgactagctgcggtgctcgcatgatcttctaa

SEQ ID NO: 175 - protein, 880 aa, Chlamydia
  VARIANT (1)...(880): Xaa = Any Amino Acid
AIMRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLXKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYVHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRTYYYFLGAYIQDLKRDVESGPVVLLKNAVSWDAPMANLDSRAYMFRLTNQRALHRLQTLLNVSCVLRGQSHSYSLDLGTTYRF

SEQ ID NO: 176 - protein, 982 aa, Chlamydia
  VARIANT (1)...(982): Xaa = Any Amino Acid
MIPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTSGQASNTSNNYGDGGAIFCKNGAQAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTQQALCGSYLFGDAFIRASYGFGNQHMKTSYTFAEESDVRWDNNCLAGEIGAGLPIVITPSKLYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSKVXF

SEQ ID NO: 177 - protein, 964 aa, Chlamydia
MKKAFFFFLIGNSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIATQLLASKGIWFGSGSPSSRHAMSYKISQQTQPLSWLTLHFQYHGFYSSSTFCNYLNGEIALRF

SEQ ID NO: 178 - protein, 1530 aa, Chlamydia
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSVEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLKERKSAEVLLINSRENPGYTGSIRFLEAESKVPQCIHVQQGSLELLNGATLCSYGFKQDAGAKLVLAAGSKLKILDSGTPVQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIHVATPEIEEDTYGHMGDWSEAKIQDGTLVINWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 179 - protein, 1776 aa, Chlamydia
AIMKFMSATAVFAAVLSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNPSIELHDNSFFFGEGEVIFDHRVALKNGGAIYGEKEVVFENIKSLLVEVNISVEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETKDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSNVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMTF

SEQ ID NO: 180 - protein, 1752 aa, Chlamydia
MKWLSATAVFAAVLPSVSGFCFPEPKELNFSRVETSSSTTFTETIGEAGAEYIVSGNASFTKFTNIPTTDTTTPTNSNSSSSSGETASVSEDSDSTTTTPDPKGGGAFYNAHSGVLSFMTRSGTEGSLTLSEIKMTGEGGAIFSQGELLFTDLTSLTIQNNLSQLSGGAIFGGSTISLSGITKATFSCNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGGINFQDLEEIRIKYNKAGTFETKKITLPSLKAQASAGNADAWASSSPQSGSGATTVSDSGDSSSGSDSDTSETVPVTAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASIATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQNVYETLDINKEENSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAVPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKIVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 181 - DNA, 2601 bp, Chlamydia
atggctagccatcaccatcaccatcacctctttggccaggatcccttaggtgaaaccgccctcctcactaaaaatcctaatcatgtcgtctgtacattttttgaggactgtaccatggagagcctctttcctgctctttgtgctcatgcatcacaagacgatcctttgtatgtacttggaaattcctactgttggttcgtatctaaactccatatcacggaccccaaagaggctctttttaaagaaaaaggagatctttccattcaaaactttcgcttcctttccttcacagattgctcttccaaggaaagctctccttctattattcatcaaaagaatggtcagttatccttgcgcaataatggtagcatgagtttctgtcgaaatcatgctgaaggctctggaggagccatctctgcggatgccttttctctacagcacaactatcttttcacagcttttgaagagaattcttctaaaggaaatggcggagccattcaggctcaaaccttctctttatctagaaatgtgtcgcctatttctttcgcccgtaatcgtgcggatttaaatggcggcgctatttgctgtagtaatcttatttgttcagggaatgtaaaccctctctttttcactggaaactccgccacraatggaggcsctatttgttgtatcagcgatctaaacacctcagaaaaaggctctctctctcttgcttgtaaccaaraaacgctatttgcaagcaattctgctaaagaaaaaggcggggctatttatgccaagcacatggtattgcgttataacggtcctgtttccttcattaacaacagcgctaaaataggtggagctatcgccatccagtccggagggagtctctctatccttgcaggtgaaggatctgttctgttccagaataactcccaacgcacctccgaccaaggtctagtaagaaacgccatctacttagagaaagatgcgattctttcttccttagaagctcgcaacggagatattcttttctttgatcctattgtacaagaaagtagcagcaaagaatcgcctcttccctcctctttgcaagccagcgtgacttctcccaccccagccaccgcatctcctttagttattcagacaagtgcaaaccgttcagtgattttctcgagcgaacgtctttctgaagaagaaaaaactcctgataacctcacttcccaactacagcagcctatcgaactgaaatccggacgcttagttttaaaagatcgcgctgtcctttccgsgccttctctctctcaggatcctcaagctctcctcattatggaagcgggaacttctttaaaaacttcctytgatttgaagttagstacgstaagtattccccttcattccttagatactgaaaaaagcgtaactatccacgcccctaatctttctatccaaaagatcttcctctctaactctggagatgagaatttttatgaaaatgtagagcttctcagtaaagagcaaaacaatattcctctccttactctccctaaagagcaatctcatttacatcttcctgatgggaacctctcttctcactttggatatcaaggagattggactttttcttggaaagattctgatgaagggcattctctgattgctaattggacgcctaaaaactatgtgcctcatccagaacgtcaatctacactcgttgcgaacactctttggaacacctattccgatatgcaagctgtgcagtcgatgattaatacaacagcgcacggaggagcctatctatttggaacgtggggatctgctgtttctaatttattctatgttcacgacagctctgggaaacctatcgataattggcatcatagaagccttggctacctattcggtatcagtactcacagtttagatgaccattctttctgcttggctgcaggacaattactcgggaaatcgtccgattcctttattacgtctacagaaacgacctcctatatagctactgtacaagcgcaactcgctacctctctaatgaaaatctctgcacaggcatgctacaatgaaagtatccatgagctaaaaacaaaatatcgctccttctctaaagaaggattcggatcctggcatagcgttgcagtatccggagaagtgtgcgcatcgattcctattgtatccaatggttccggactgttcagctccttctctattttctctaaactgcaaggattttcaggaacacaggacggttttgaggagagttcgggagagattcggtccttttctgccagctctttcagaaatatttcacttcctataggaataacatttgaaaaaaaatcccaaaaaacacgaacctactattactttctaggagcctacatccaagacctgaaacgtgatgtggaatcgggacctgtagtgttactcaaaaatgccgtctcctgggatgctcctatggcgaacttggattcacgagcctacatgttccggcttacgaatcaaagagctctacacagacttcagacgctgttaaatgtgtcttgtgtgctgcgtgggcaaagccatagttactccctggatctggggaccacttacaggttctag

SEQ ID NO: 182 - DNA, 3021 bp, Chlamydia
atggctagcatgactggtggacagcaaatgggtcgggattcaagcttggtaccgcatcaccatcaccatcacatgattcctcaaggaatttacgatggggagacgttaactgtatcatttccctatactgttataggagatccgagtgggactactgttttttctgcaggagagttaacattaaaaaatcttgacaattctattgcagctttgcctttaagttgttttgggaacttattagggagttttactgttttagggagaggacactcgttgactttcgagaacatacggacttctacaaatggggcagctctaagtaatagcgctgctgatggactgtttactattgagggttttaaagaattatccttttccaattgcaattcattacttgccgtactgcctgctgcaacgactaataagggtagccagactccgacgacaacatctacaccgtctaatggtactatttattctaaaacagatcttttgttactcaataatgagaagttctcattctatagtaatttagtctctggagatgggggagctatagatgctaagagcttaacggttcaaggaattagcaagctttgtgtcttccaagaaaatactgctcaagctgatgggggagcttgtcaagtagtcaccagtttctctgctatggctaacgaggctcctattgcctttgtagcgaatgttgcaggagtaagagggggagggattgctgctgttcaggatgggcagcagggagtgtcatcatctacttcaacagaagatccagtagtaagtttttccagaaatactgcggtagagtttgatgggaacgtagcccgagtaggaggagggatttactcctacgggaacgttgctttcctgaataatggaaaaaccttgtttctcaacaatgttgcttctcctgtttacattgctgctaagcaaccaacaagtggacaggcttctaatacgagtaataattacggagatggaggagctatcttctgtaagaatggtgcgcaagcaggatccaataactctggatcagtttcctttgatggagagggagtagttttctttagtagcaatgtagctgctgggaaagggggagctatttatgccaaaaagctctcggttgctaactgtggccctgtacaatttttaaggaatatcgctaatgatggtggagcgatttatttaggagaatctggagagctcagtttatctgctgattatggagatattattttcgatgggaatcttaaaagaacagccaaagagaatgctgccgatgttaatggcgtaactgtgtcctcacaagccatttcgatgggatcgggagggaaaataacgacattaagagctaaagcagggcatcagattctctttaatgatcccatcgagatggcaaacggaaataaccagccagcgcagtcttccaaacttctaaaaattaacgatggtgaaggatacacaggggatattgtttttgctaatggaagcagtactttgtaccaaaatgttacgatagagcaaggaaggattgttcttcgtgaaaaggcaaaattatcagtgaattctctaagtcagacaggtgggagtctgtatatggaagctgggagtacattggattttgtaactccacaaccaccacaacagcctcctgccgctaatcagttgatcacgctttccaatctgcatttgtctctttcttctttgttagcaaacaatgcagttacgaatcctcctaccaatcctccagcgcaagattctcatcctgcagtcattggtagcacaactgctggttctgttacaattagtgggcctatcttttttgaggatttggatgatacagcttatgataggtatgattggctaggttctaatcaaaaaatcaatgtcctgaaattacagttagggactaagcccccagctaatgccccatcagatttgactctagggaatgagatgcctaagtatggctatcaaggaagctggaagcttgcgtgggatcctaatacagcaaataatggtccttatactctgaaagctacatggactaaaactgggtataatcctgggcctgagcgagtagcttctttggttccaaatagtttatggggatccattttagatatacgatctgcgcattcagcaattcaagcaagtgtggatgggcgctcttattgtcgaggattatgggtttctggagtttcgaatttcttctatcatgaccgcgatgctttaggtcagggatatcggtatattagtgggggttattccttaggagcaaactcctactttggatcatcgatgtttggtctagcatttaccgaagtatttggtagatctaaagattatgtagtgtgtcgttccaatcatcatgcttgcataggatccgtttatctatctacccaacaagctttatgtggatcctatttgttcggagatgcgtttatccgtgctagctacgggtttgggaatcagcatatgaaaacctcatatacatttgcagaggagagcgatgttcgttgggataataactgtctggctggagagattggagcgggattaccgattgtgattactccatctaagctctatttgaatgagttgcgtcctttcgtgcaagctgagttttcttatgccgatcatgaatcttttacagaggaaggcgatcaagctcgggcattcaagagcggacatctcctaaatctatcagttcctgttggagtgaagtttgatcgatgttctagtacacatcctaataaatatagctttatggcggcttatatctgtgatgcttatcgcaccatctctggtactgagacaacgctcctatcccatcaagagacatggacaacagatgcctttcatttagcaagacatggagttgtggttagaggatctatgtatgcttctctaacaagtaatatagaagtatatggccatggaagatatgagtatcgagatgcttctcgaggctatggtttgagtgcaggaagtaaagtccggttctaa

SEQ ID NO: 183 - DNA, 2934 bp, Chlamydia
atggctagcatgactggtggacagcaaatgggtcgggattcaagcttggtaccgagctcggatccacatcaccatcaccatcacggactagctagagaggttccttctagaatctttcttatgcccaactcagttccagatcctacgaaagagtcgctatcaaataaaattagtttgacaggagacactcacaatctcactaactgctatctcgataacctacgctacatactggctattctacaaaaaactcccaatgaaggagctgctgtcacaataacagattacctaagcttttttgatacacaaaaagaaggtatttattttgcaaaaaatctcacccctgaaagtggtggtgcgattggttatgcgagtcccaattctcctaccgtggagattcgtgatacaataggtcctgtaatctttgaaaataatacttgttgcagactatttacatggagaaatccttatgctgctgataaaataagagaaggcggagccattcatgctcaaaatctttacataaatcataatcatgatgtggtcggatttatgaagaacttttcttatgtccaaggaggagccattagtaccgctaatacctttgttgtgagcgagaatcagtcttgttttctctttatggacaacatctgtattcaaactaatacagcaggaaaaggtggcgctatctatgctggaacgagcaattcttttgagagtaataactgcgatctcttcttcatcaataacgcctgttgtgcaggaggagcgatcttctcccctatctgttctctaacaggaaatcgtggtaacatcgttttctataacaatcgctgctttaaaaatgtagaaacagcttcttcagaagcttctgatggaggagcaattaaagtaactactcgcctagatgttacaggcaatcgtggtaggatcttttttagtgacaatatcacaaaaaattatggcggagctatttacgctcctgtagttaccctagtggataatggccctacctactttataaacaatatcgccaataataaggggggcgctatctatatagacggaaccagtaactccaaaatttctgccgaccgccatgctattatttttaatgaaaatattgtgactaatgtaactaatgcaaatggtaccagtacgtcagctaatcctcctagaagaaatgcaataacagtagcaagctcctctggtgaaattctattaggagcagggagtagccaaaatttaattttttatgatcctattgaagttagcaatgcaggggtctctgtgtccttcaataaggaagctgatcaaacaggctctgtagtattttcaggagctactgttaattctgcagattttcatcaacgcaatttacaaacaaaaacacctgcaccccttactctcagtaatggttttctatgtatcgaagatcatgctcagcttacagtgaatcgattcacacaaactgggggtgttgtttctcttgggaatggagcagttctgagttgctataaaaatggtacaggagattctgctagcaatgcctctataacactgaagcatattggattgaatctttcttccattctgaaaagtggtgctgagattcctttattgtgggtagagcctacaaataacagcaataactatacagcagatactgcagctaccttttcattaagtgatgtaaaactctcactcattgatgactacgggaactctccttatgaatccacagatctgacccatgctctgtcatcacagcctatgctatctatttctgaagctagcgataaccagctacaatcagaaaatatagatttttcgggactaaatgtccctcattatggatggcaaggactttggacttggggctgggcaaaaactcaagatccagaaccagcatcttcagcaacaatcactgatccacaaaaagccaatagatttcatagaaccttactactaacatggcttcctgccgggtatgttcctagcccaaaacacagaagtcccctcatagctaacaccttatgggggaatatgctgcttgcaacagaaagcttaaaaaatagtgcagagctgacacctagtggtcatcctttctggggaattacaggaggaggactaggcatgatggtttaccaagatcctcgagaaaatcatcctggattccatatgcgctcttccggatactctgcggggatgatagcagggcagacacacaccttctcattgaaattcagtcagacctacaccaaactcaatgagcgttacgcaaaaaacaacgtatcttctaaaaattactcatgccaaggagaaatgctcttctcattgcaagaaggtttcttgctgactaaattagttgggctttacagctatggagaccataactgtcaccatttctatactcaaggagaaaatctaacatctcaagggacgttccgcagtcaaacgatgggaggtgctgtcttttttgatctccctatgaaaccctttggatcaacgcatatactgacagctccctttttaggtgctcttggtatttattctagcctgtctcactttactgaggtgggagcctatccgcgaagcttttctacaaagactcctttgatcaatgtcctagtccctattggagttaaaggtagctttatgaatgctacccacagacctcaagcctggactgtagaattggcataccaacccgttctgtatagacaagaaccagggatcgcgacccagctcctagccagtaaaggtatttggtttggtagtggaagcccctcatcgcgtcatgccatgtcctataaaatctcacagcaaacacaacctttgagttggttaactctccatttccagtatcatggattctactcctcttcaaccttctgtaattatctcaatggggaaattgctctgcgattctag

SEQ ID NO: 184 - DNA, 2547 bp, Chlamydia
atggctagccatcaccatcaccatcacggtgctatttcttgcttacgtggagatgtagtcatttctggaaacaagggtagagttgaatttaaagacaacatagcaacacgtctttatgtggaagaaactgtagaaaaggttgaagaggtagagccagctcctgagcaaaaagacaataatgagctttctttcttagggagtgtagaacagagttttattactgcagctaatcaagctcttttcgcatctgaagatggggatttatcacctgagtcatccatttcttctgaagaacttgcgaaaagaagagagtgtgctggaggagctatttttgcaaaacgggttcgtattgtagataaccaagaggccgttgtattctcgaataacttctctgatatttatggcggcgccatttttacaggttctcttcgagaagaggataagttagatgggcaaatccctgaagtcttgatctcaggcaatgcaggggatgttgttttttccggaaattcctcgaagcgtgatgagcatcttcctcatacaggtgggggagccatttgtactcaaaatttgacgatttctcagaatacagggaatgttctgttttataacaacgtggcctgttcgggaggagctgttcgtatagaggatcatggtaatgttcttttagaagcttttggaggagatattgtttttaaaggaaattcttctttcagagcacaaggatccgatgctatctattttgcaggtaaagaatcgcatattacagccctgaatgctacggaaggacatgctattgttttccacgacgcattagtttttgaaaatctaaaagaaaggaaatctgctgaagtattgttaatcaatagtcgagaaaatccaggttacactggatctattcgatttttagaagcagaaagtaaagttcctcaatgtattcatgtacaacaaggaagccttgagttgctaaatggagctacattatgtagttatggttttaaacaagatgctggagctaagttggtattggctgctggatctaaactgaagattttagattcaggaactcctgtacaagggcatgctatcagtaaacctgaagcagaaatcgagtcatcttctgaaccagagggtgcacattctctttggattgcgaagaatgctcaaacaacagttcctatggttgatatccatactatttctgtagatttagcctccttctcttctagtcaacaggaggggacagtagaagctcctcaggttattgttcctggaggaagttatgttcgatctggagagcttaatttggagttagttaacacaacaggtactggttatgaaaatcatgctttgttgaagaatgaggctaaagttccattgatgtctttcgttgcttctagtgatgaagcttcagccgaaatcagtaacttgtcggtttctgatttacagattcatgtagcaactccagagattgaagaagacacatacggccatatgggagattggtctgaggctaaaattcaagatggaactcttgtcattaattggaatcctactggatatcgattagatcctcaaaaagcaggggctttagtatttaatgcattatgggaagaaggggctgtcttgtctgctctgaaaaatgcacgctttgctcataatctcactgctcagcgtatggaattcgattattctacaaatgtgtggggattcgcctttggtggtttccgaactctatctgcagagaatctggttgctattgatggatacaaaggagcttatggtggtgcttctgctggagtcgatattcaattgatggaagattttgttctaggagttagtggagctgctttcctaggtaaaatggatagtcagaagtttgatgcggaggtttctcggaagggagttgttggttctgtatatacaggatttttagctggatcctggttcttcaaaggacaatatagccttggagaaacacagaacgatatgaaaacgcgttatggagtactaggagagtcgagtgcttcttggacatctcgaggagtactggcagatgctttagttgaataccgaagtttagttggtcctgtgagacctactttttatgctttgcatttcaatccttatgtcgaagtatcttatgcttctatgaaattccctggctttacagaacaaggaagagaagcgcgttcttttgaagacgcttcccttaccaatatcaccattcctttagggatgaagtttgaattggcgttcataaaaggacagttttcagaggtgaactctttgggaataagttatgcatgggaagcttatcgaaaagtagaaggaggcgcggtgcagcttttagaagctgggtttgattgggagggagctccaatggatcttcctagacaggagctgcgtgtcgctctggaaaataatacggaatggagttcttacttcagcacagtcttaggattaacagctttttgtggaggatttacttctacagatagtaaactaggatatgaggcgaatactggattgcgattgatcttttaa

SEQ ID NO: 185 - DNA, 2337 bp, Chlamydia
atgcatcaccatcaccatcacgggttagctagttgcgtagatcttcatgctggaggacagtctgtaaatgagctggtatatgtaggccctcaagcggttttattgttagaccaaattcgagatctattcgttgggtctaaagatagtcaggctgaaggacagtataggttaattgtaggagatccaagttctttccaagagaaagatgcagatactcttcccgggaaggtagagcaaagtactttgttctcagtaaccaatcccgtggttttccaaggtgtggaccaacaggatcaagtctcttcccaagggttaatttgtagttttacgagcagcaaccttgattctccccgtgacggagaatcttttttaggtattgcttttgttggggatagtagtaaggctggaatcacattaactgacgtgaaagcttctttgtctggagcggctttatattctacagaagatcttatctttgaaaagattaagggtggattggaatttgcatcatgttcttctctagaacaggggggagcttgtgcagctcaaagtattttgattcatgattgtcaaggattgcaggttaaacactgtactacagccgtgaatgctgaggggtctagtgcgaatgatcatcttggatttggaggaggcgctttctttgttacgggttctctttctggagagaaaagtctctatatgcctgcaggagatatggtagttgcgaattgtgatggggctatatcttttgaaggaaacagcgcgaactttgctaatggaggagcgattgctgcctctgggaaagtgctttttgtcgctaatgataaaaagacttcttttatagagaaccgagctttgtctggaggagcgattgcagcctcttctgatattgcctttcaaaactgcgcagaactagttttcaaaggcaattgtgcaattggaacagaggataaaggttctttaggtggaggggctatatcttctctaggcaccgttcttttgcaagggaatcacgggataacttgtgataagaatgagtctgcttcgcaaggaggcgccatttttggcaaaaattgtcagatttctgacaacgaggggccagtggttttcagagatagtacagcttgcttaggaggaggcgctattgcagctcaagaaattgtttctattcagaacaatcaggctgggatttccttcgagggaggtaaggctagtttcggaggaggtattgcgtgtggatctttttcttccgcaggcggtgcttctgttttagggactattgatatttcgaagaatttaggcgcgatttcgttctctcgtactttatgtacgacctcagatttaggacaaatggagtaccagggaggaggagctctatttggtgaaaatatttctctttctgagaatgctggtgtgctcacctttaaagacaacattgtgaagacttttgcttcgaatgggaaaattctgggaggaggagcgattttagctactggtaaggtggaaattaccaataattccggaggaatttcttttacaggaaatgcgagagctccacaagctcttccaactcaagaggagtttcctttattcagcaaaaaagaagggcgaccactctcttcaggatattctgggggaggagcgattttaggaagagaagtagctattctccacaacgctgcagtagtatttgagcaaaatcgtttgcagtgcagcgaagaagaagcgacattattaggttgttgtggaggaggcgctgttcatgggatggatagcacttcgattgttggcaactcttcagtaagatttggtaataattacgcaatgggacaaggagtctcaggaggagctcttttatctaaaacagtgcagttagctggaaatggaagcgtcgatttttctcgaaatattgctagtttgggaggaggagctcttcaagcttctgaaggaaattgtgagctagttgataacggctatgtgctattcagagataatcgagggagggtttatgggggtgctatttcttgcttacgtggagatgtagtcatttctggaaacaagggtagagttgaatttaaagacaacatagcaacacgtctttatgtggaagaaactgtagaaaaggttgaagaggtagagccagctcctgagcaaaaagacaataatgagctttctttcttagggagtgtagaacagagttttattactgcagctaatcaagctcttttcgcatctgaagatggggatttatcacctgagtcatccatttcttctgaagaacttgcgaaaagaagagagtgtgctggaggagctgactcgagcagatccggctgctaa

SEQ ID NO: 186 - DNA, 2847 bp, Chlamydia
atggctagcatgcatcaccatcaccatcacgttaagattgagaacttctctggccaaggaatattttctggaaacaaagctatcgataacaccacagaaggctcctcttccaaatctaacgtcctcggaggtgcggtctatgctaaaacattgtttaatctcgatagcgggagctctagacgaactgtcaccttctccgggaatactgtctcttctcaatctacaacaggtcaggttgctggaggagctatctactctcctactgtaaccattgctactcctgtagtattttctaaaaactctgcaacaaacaatgctaataacgctacagatactcagagaaaagacacctttggaggagctatcggagctacttctgctgtttctctatcaggaggggctcatttcttagaaaacgttgctgacctcggatctgctattgggttggtgccagacacacaaaatacagaaacagtgaaattagagtctggctcctactactttgaaaaaaataaagctttaaaacgagctactatttacgcacctgtcgtttccattaaagcctatactgcgacatttaaccaaaacagatctctagaagaaggaagcgcgatttactttacaaaagaagcatctattgagtctttaggctctgttctcttcacaggaaacttagtaaccccaacgctaagcacaactacagaaggcacaccagccacaacctcaggagatgtaacaaaatatggtgctgctatctttggacaaatagcaagctcaaacggatctcagacggataaccttcccctgaaactcattgcttcaggaggaaatatttgtttccgaaacaatgaataccgtcctacttcttctgataccggaacctctactttctgtagtattgcgggagatgttaaattaaccatgcaagctgcaaaagggaaaacgatcagtttctttgatgcaatccggacctctactaagaaaacaggtacacaggcaactgcctacgatactctcgatattaataaatctgaggattcagaaactgtaaactctgcgtttacaggaacgattctgttctcctctgaattacatgaaaataaatcctatattccacaaaacgtagttctacacagtggatctcttgtattgaagccaaataccgagcttcatgtcatttcttttgagcagaaagaaggctcttctctcgttatgacacctggatctgttctttcgaaccagactgttgctgatggagctttggtcataaataacatgaccattgatttatccagcgtagagaaaaatggtattgctgaaggaaatatctttactcctccagaattgagaatcatagacactactacaagtggaagcggtggaaccccatctacagatagtgaaagtaaccagaatagtgatgataccaaggagcaaaataataatgacgcctcgaatcaaggagaaagcgcgaatggatcgtcttctcctgcagtagctgctgcacacacatctcgtacaagaaactttgccgctgcagctacagccacacctacgacaacaccaacggctacaactacaacaagcaaccaagtaatcctaggaggagaaatcaaactcatcgatcctaatgggaccttcttccagaaccctgcattaagatccgaccaacaaatctccttgttagtgctccctacagactcatcaaaaatgcaagctcagaaaatagtactgacgggtgatattgctcctcagaaaggatatacaggaacactcactctggatcctgatcaactacaaaatggaacgatctcagcgctctggaaatttgactcttatagacaatgggcttatgtacctagagacaatcatttctatgcgaactcgattctgggatctcaaatgtcaatggtcacagtcaaacaaggcttgctcaacgataaaatgaatctagctcgctttgatgaagttagctataacaacctgtggatatcaggactaggaacgatgctatcgcaagtaggaacacctacttctgaagaattcacttattacagcagaggagcttctgttgccttagatgctaaaccagcccatgatgtgattgttggagctgcatttagtaagatgatcgggaaaacaaaatccttgaaaagagagaataactacactcacaaaggatccgaatattcttaccaagcatcggtatacggaggcaaaccattccactttgtaatcaataaaaaaacggaaaaatcgctaccgctattgttacaaggagtcatctcttacggatatatcaaacatgatacagtgactcactatccaacgatccgtgaacgaaaccaaggagaatgggaagacttaggatggctgacagctctccgtgtctcctctgtcttaagaactcctgcacaaggggatactaaacgtatcactgtttacggagaattggaatactccagtatccgtcagaaacaattcacagaaacagaatacgatcctcgttacttcgacaactgcacctatagaaacttagcaattcctatggggttagcattcgaaggagagctctctggtaacgatattttgatgtacaacagattctctgtagcatacatgccatcaatctatcgaaattctccaacatgcaaataccaagtgctctcttcaggagaaggcggagaaattatttgtggagtaccgacaagaaactcagctcgcggagaatacagcacgcagctgtacccgggacctttgtggactctgtatggatcctacacgatagaagcagacgcacatacactagctcatatgatgaactgcggtgctcgtatgacattctaa

SEQ ID NO: 187 - DNA, 2466 bp, Chlamydia
atgcatcaccatcaccatcacgaggcgagctcgatccaagatcaaataaagaataccgactgcaatgttagcaaagtaggatattcaacttctcaagcatttactgatatgatgctagcagacaacacagagtatcgagctgctgatagtgtttcattctatgacttttcgacatcttccggattacctagaaaacatcttagtagtagtagtgaagcttctccaacgacagaaggagtgtcttcatcttcatctggagaaaatactgagaattcacaagattcagctccctcttctggagaaactgataagaaaacagaagaagaactagacaatggcggaatcatttatgctagagagaaactaactatctcagaatctcaggactctctctctaatccaagcatagaactccatgacaatagttttttcttcggagaaggtgaagttatctttgatcacagagttgccctcaaaaacggaggagctatttatggagagaaagaggtagtctttgaaaacataaaatctctactagtagaagtaaatatctcggtcgagaaagggggtagcgtctatgcaaaagaacgagtatctttagaaaatgttaccgaagcaaccttctcctccaatggtggggaacaaggtggtggtggaatctattcagaacaagatatgttaatcagtgattgcaacaatgtacatttccaagggaatgctgcaggagcaacagcagtaaaacaatgtctggatgaagaaatgatcgtattgctcacagaatgcgttgatagcttatccgaagatacactggatagcactccagaaacggaacagactaagtcaaatggaaatcaagatggttcgtctgaaacaaaagatacacaagtatcagaatcaccagaatcaactcctagccccgacgatgttttaggtaaaggtggtggtatctatacagaaaaatctttgaccatcactggaattacagggactatagattttgtcagtaacatagctaccgattctggagcaggtgtattcactaaagaaaacttgtcttgcaccaacacgaatagcctacagtttttgaaaaactcggcaggtcaacatggaggaggagcctacgttactcaaaccatgtctgttactaatacaactagtgaaagtataactactccccctctcgtaggagaagtgattttctctgaaaatacagctaaagggcacggtggtggtatctgcactaacaaactttctttatctaatttaaaaacggtgactctcactaaaaactctgcaaaggagtctggaggagctatttttacagatctagcgtctataccaacaacagataccccagagtcttctaccccctcttcctcctcgcctgcaagcactcccgaagtagttgcttctgctaaaataaatcgattctttgcctctacggcagaaccggcagccccttctctaacagaggctgagtctgatcaaacggatcaaacagaaacttctgatactaatagcgatatagacgtgtcgattgagaacattttgaatgtcgctatcaatcaaaacacttctgcgaaaaaaggaggggctatttacgggaaaaaagctaaactttcccgtattaacaatcttgaactttcagggaattcatcccaggatgtaggaggaggtctctgtttaactgaaagcgtagaatttgatgcaattggatcgctcttatcccactataactctgctgctaaagaaggtggggttattcattctaaaacggttactctatctaacctcaagtctaccttcacttttgcagataacactgttaaagcaatagtagaaagcactcctgaagctccagaagagattcctccagtagaaggagaagagtctacagcaacagaaaatccgaattctaatacagaaggaagttcggctaacactaaccttgaaggatctcaaggggatactgctgatacagggactggtgttgttaacaatgagtctcaagacacatcagatactggaaacgctgaatctggagaacaactacaagattctacacaatctaatgaagaaaatacccttcccaatagtagtattgatcaatctaacgaaaacacagacgaatcatctgatagccacactgaggaaataactgacgagagtgtctcatcgtcctctaaaagtggatcatctactcctcaagatggaggagcagcttcttcaggggctccctcaggagatcaatctatctctgcaaacgcttgtttagctaaaagctatgctgcgagtactgatagctcccctgtatctaattcttcaggttcagacgttactgcatcttctgataatccagactcttcctcatctggagatagcgctggagactctgaaggaccgactgagccagaagctggttctacaacagaaactcctactttaataggaggaggtgctatctga

SEQ ID NO: 188 - DNA, 1578 bp, Chlamydia
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcccgctagtacctagaggttcaccgctgcctgtggggaatccagctgaaccaagtttattaatcgatggcactatgtgggaaggtgcttcaggagatccttgcgatccttgcgctacttggtgtgacgccattagcatccgcgcaggatactacggagattatgttttcgatcgtgtattaaaagttgatgtgaataaaacttttagcggcatggctgcaactcctacgcaggctataggtaacgcaagtaatactaatcagccagaagcaaatggcagaccgaacatcgcttacggaaggcatatgcaagatgcagagtggttttcaaatgcagccttcctagccttaaacatttgggatcgcttcgacattttctgcaccttaggggcatccaatggatacttcaaagcaagttcggctgcattcaacttggttgggttaatagggttttcagctgcaagctcaatctctaccgatcttccaatgcaacttcctaacgtaggcattacccaaggtgttgtggaattttatacagacacatcattttcttggagcgtaggtgcacgtggagctttatgggaatgtggttgtgcaactttaggagctgagttccaatacgctcaatctaatcctaagattgagatgctcaacgtcacttcaagcccagcacaatttgtgattcacaaaccaagaggctataaaggagctagctcgaattttcctttacctataacggctggaacaacagaagctacagacaccaaatcagctacaattaaataccatgaatggcaagtaggcctcgccctgtcttacagattgaatatgcttgttccatatattggcgtaaactggtcaagagcaacttttgatgctgatactatccgcattgctcaacctaaattaaaatcggagattcttaacattactacatggaacccaagccttataggatcaaccactgctttgcccaataatagtggtaaggatgttctatctgatgtcttgcaaattgcttcgattcagatcaacaaaatgaagtctagaaaagcttgtggtgtagctgttggtgcaacgttaatcgacgctgacaaatggtcaatcactggtgaagcacgcttaatcaatgaaagagctgctcacatgaatgcacaattccgcttctaa

SEQ ID NO: 189 - protein, 866 aa, Chlamydia
  VARIANT (1)...(866): Xaa = Any Amino Acid
MASHHHHHHLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGXICCISDLNTSEKGSLSLACNQXTLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSXPSLSQDPQALLIMEAGTSLKTSXDLKLXTXSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYVHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRTYYYFLGAYIQDLKRDVESGPVVLLKNAVSWDAPMANLDSRAYMFRLTNQRALHRLQTLLNVSCVLRGQSHSYSLDLGTTYRF

SEQ ID NO: 190 - protein, 1006 aa, Chlamydia
MASMTGGQQMGRDSSLVPHHHHHHMIPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTSGQASNTSNNYGDGGAIFCKNGAQAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTQQALCGSYLFGDAFIRASYGFGNQHMKTSYTFAEESDVRWDNNCLAGEIGAGLPIVITPSKLYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSKVRF

SEQ ID NO: 191 - protein, 977 aa, Chlamydia
MASMTGGQQMGRDSSLVPSSDPHHHHHHGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIATQLLASKGIWFGSGSPSSRHAMSYKISQQTQPLSWLTLHFQYHGFYSSSTFCNYLNGEIALRF

SEQ ID NO: 192 - protein, 848 aa, Chlamydia
MASHHHHHHGAISCLRGDVVISGNKGRVEFKDNIATRLYVEETVEKVEEVEPAPEQKDNNELSFLGSVEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLKERKSAEVLLINSRENPGYTGSIRFLEAESKVPQCIHVQQGSLELLNGATLCSYGFKQDAGAKLVLAAGSKLKILDSGTPVQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIHVATPEIEEDTYGHMGDWSEAKIQDGTLVINWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 193 - protein, 778 aa, Chlamydia
MHHHHHHGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSVEQSFITAANQALFASEDGDLSPESSISSEELAKRRECAGGADSSRSGC

SEQ ID NO: 194 - protein, 948 aa, Chlamydia
MASMHHHHHHVKIENFSGQGIFSGNKAIDNTTEGSSSKSNVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMTF

SEQ ID NO: 195 - protein, 821 aa, Chlamydia
MHHHHHHEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNPSIELHDNSFFFGEGEVIFDHRVALKNGGAIYGEKEVVFENIKSLLVEVNISVEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETKDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAI

SEQ ID NO: 196 - protein, 525 aa, Chlamydia
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFPLVPRGSPLPVGNPAEPSLLIDGTMWEGASGDPCDPCATWCDAISIRAGYYGDYVFDRVLKVDVNKTFSGMAATPTQAIGNASNTNQPEANGRPNIAYGRHMQDAEWFSNAAFLALNIWDRFDIFCTLGASNGYFKASSAAFNLVGLIGFSAASSISTDLPMQLPNVGITQGVVEFYTDTSFSWSVGARGALWECGCATLGAEFQYAQSNPKIEMLNVTSSPAQFVIHKPRGYKGASSNFPLPITAGTTEATDTKSATIKYHEWQVGLALSYRLNMLVPYIGVNWSRATFDADTIRIAQPKLKSEILNITTWNPSLIGSTTALPNNSGKDVLSDVLQIASIQINKMKSRKACGVAVGATLIDADKWSITGEARLINERAAHMNAQFRF

SEQ ID NO: 197 - DNA, 43 bp, Chlamydia
gataggcgcgccgcaatcatgaaatttatgtcagctactgctg

SEQ ID NO: 198 - DNA, 34 bp, Chlamydia
cagaacgcgtttagaatgtcatacgagcaccgca

SEQ ID NO: 199 - DNA, 6 bp, Chlamydia
gcaatc

SEQ ID NO: 200 - DNA, 34 bp, Chlamydia
tgcaatcatgagttcgcagaaagatataaaaagc

SEQ ID NO: 201 - DNA, 38 bp, Chlamydia
cagagctagcttaaaagatcaatcgcaatccagtattc

SEQ ID NO: 202 - DNA, 5 bp, Chlamydia
caatc

SEQ ID NO: 203 - DNA, 31 bp, Chlamydia
tgcaatcatgaaaaaagcgtttttctttttc

SEQ ID NO: 204 - DNA, 31 bp, Chlamydia
cagaacgcgtctagaatcgcagagcaatttc

SEQ ID NO: 205 - DNA, 30 bp, Chlamydia
gtgcaatcatgattcctcaaggaatttacg

SEQ ID NO: 206 - DNA, 31 bp, Chlamydia
cagaacgcgtttagaaccggactttacttcc

SEQ ID NO: 207 - DNA, 50 bp, Chlamydia
cagacatatgcatcaccatcaccatcacgaggcgagctcgatccaagatc

SEQ ID NO: 208 - DNA, 40 bp, Chlamydia
cagaggtacctcagatagcactctctcctattaaagtagg

SEQ ID NO: 209 - DNA, 55 bp, Chlamydia
cagagctagcatgcatcaccatcaccatcacgttaagattgagaacttctctggc

SEQ ID NO: 210 - DNA, 35 bp, Chlamydia
cagaggtaccttagaatgtcatacgagcaccgcag

SEQ ID NO: 211 - DNA, 36 bp, Chlamydia
cagacatatgcatcaccatcaccatcacgggttagc

SEQ ID NO: 212 - DNA, 35 bp, Chlamydia
cagaggtacctcagctcctccagcacactctcttc

SEQ ID NO: 213 - DNA, 51 bp, Chlamydia
cagagctagccatcaccatcaccatcacggtgctatttcttgcttacgtgg

SEQ ID NO: 214 - DNA, 38 bp, Chlamydia
cagaggtacttaaaagatcaatcgcaatccagtattcg

SEQ ID NO: 215 - DNA, 48 bp, Chlamydia
cagaggatccacatcaccatcaccatcacggactagctagagaggttc

SEQ ID NO: 216 - DNA, 31 bp, Chlamydia
cagagaattcctagaatcgcagagcaatttc

SEQ ID NO: 217 - DNA, 7 bp, Chlamydia
tgcaatc

SEQ ID NO: 218 - protein, 22 aa, Chlamydia
MASMTGGQQMGRDSSLVPSSDP

SEQ ID NO: 219 - DNA, 51 bp, Chlamydia
cagaggtaccgcatcaccatcaccatcacatgattcctcaaggaatttacg

SEQ ID NO: 220 - DNA, 33 bp, Chlamydia
cagagcggccgcttagaaccggactttacttcc

SEQ ID NO: 221 - protein, 24 aa, Chlamydia
MASMTGGQQNGRDSSLVPHHHHHH

SEQ ID NO: 222 - DNA, 46 bp, Chlamydia
cagagctagccatcaccatcaccatcacctctttggccaggatccc

SEQ ID NO: 223 - DNA, 30 bp, Chlamydia
cagaactagtctagaacctgtaagtggtcc

SEQ ID NO: 224 - protein, 20 aa, Artificial Sequence
  Made in a lab
MSQKNKNSAFMHPVNISTDL

SEQ ID NO: 225 - protein, 20 aa, Artificial Sequence
  Made in a lab
KNSAFMHPVNISTDLAVIVG

SEQ ID NO: 226 - protein, 20 aa, Artificial Sequence
  Made in a lab
HPVNISTDLAVIVGKGPMPR

SEQ ID NO: 227 - protein, 20 aa, Artificial Sequence
  Made in a lab
STDLAVIVGKGPMPRTEIVK

SEQ ID NO: 228 - protein, 20 aa, Artificial Sequence
  Made in a lab
VIVGKGPMPRTEIVKKVWEY

SEQ ID NO: 229 - protein, 20 aa, Artificial Sequence
  Made in a lab
GPMPRTEIVKKVWEYIKKHN

SEQ ID NO: 230 - protein, 20 aa, Artificial Sequence
  Made in a lab
IKKHNCQDQKNKRNILPDAN

SEQ ID NO: 231 - protein, 20 aa, Artificial Sequence
  Made in a lab
NCQDQKNKRNILPDANLAKV

SEQ ID NO: 232 - protein, 20 aa, Artificial Sequence
  Made in a lab
KNKRNILPDANLAKVFGSSD

SEQ ID NO: 233 - protein, 20 aa, Artificial Sequence
  Made in a lab
ILPDANLAKVFGSSDPIDMF

SEQ ID NO: 234 - protein, 20 aa, Artificial Sequence
  Made in a lab
NLAKVFGSSDPIDMFQMTKA

SEQ ID NO: 235 - protein, 22 aa, Artificial Sequence
  Made in a lab
FGSSDPIDMFQMTKALSKHIVK

SEQ ID NO: 236 - protein, 20 aa, Artificial Sequence
  Made in a lab
VEITQAVPKYATVGSPYPVE

SEQ ID NO: 237 - protein, 20 aa, Artificial Sequence
  Made in a lab
AVPKYATVGSPYPVEITATG

SEQ ID NO: 238 - protein, 20 aa, Artificial Sequence
  Made in a lab
ATVGSPYPVEITATGKRDCV

SEQ ID NO: 239 - protein, 20 aa, Artificial Sequence
  Made in a lab
PYPVEITATGKRDCVDVIIT

SEQ ID NO: 240 - protein, 21 aa, Artificial Sequence
  Made in a lab
ITATGKRDCVDVIITQQLPCE

SEQ ID NO: 241 - protein, 20 aa, Artificial Sequence
  Made in a lab
KRDCVDVIITQQLPCEAEFV

SEQ ID NO: 242 - protein, 20 aa, Artificial Sequence
  Made in a lab
DVIITQQLPCEAEFVRSDPA

SEQ ID NO: 243 - protein, 20 aa, Artificial Sequence
  Made in a lab
TQQLPCEAEFVRSDPATTPT

SEQ ID NO: 244 - protein, 20 aa, Artificial Sequence
  Made in a lab
CEAEFVRSDPATTPTADGKL

SEQ ID NO: 245 - protein, 20 aa, Artificial Sequence
  Made in a lab
VRSDPATTPTADGKLVWKID

SEQ ID NO: 246 - protein, 20 aa, Artificial Sequence
  Made in a lab
ATTPTADGKLVWKIDRLGQG

SEQ ID NO: 247 - protein, 20 aa, Artificial Sequence
  Made in a lab
ADGKLVWKIDRLGQGEKSKI

SEQ ID NO: 248 - protein, 20 aa, Artificial Sequence
  Made in a lab
VWKIDRLGQGEKSKITVWVK

SEQ ID NO: 249 - protein, 20 aa, Artificial Sequence
  Made in a lab
RLGQGEKSKITVWVKPLKEG

SEQ ID NO: 250 - protein, 20 aa, Artificial Sequence
  Made in a lab
GEKSKITVWVKPLKEGCCFT

SEQ ID NO: 251 - protein, 16 aa, Artificial Sequence
  Made in a lab
GEKSKITVWVKPLKEG

SEQ ID NO: 252 - protein, 12 aa, Artificial Sequence
  Made in a lab
KITVWVKPLKEG

SEQ ID NO: 253 - protein, 16 aa, Artificial Sequence
  Made in a lab
GDKCKITVWVKPLKEG

SEQ ID NO: 254 - protein, 20 aa, Artificial Sequence
  Made in a lab
TEYPLLADPSFKISEAFGVL

SEQ ID NO: 255 - protein, 20 aa, Artificial Sequence
  Made in a lab
LADPSFKISEAFGVLNPEGS

SEQ ID NO: 256 - protein, 20 aa, Artificial Sequence
  Made in a lab
FKISEAFGVLNPEGSLALRA

SEQ ID NO: 257 - protein, 20 aa, Artificial Sequence
  Made in a lab
AFGVLNPEGSLALRATFLID

SEQ ID NO: 258 - protein, 20 aa, Artificial Sequence
  Made in a lab
NPEGSLALRATFLIDKHGVI

SEQ ID NO: 259 - protein, 20 aa, Artificial Sequence
  Made in a lab
LALRATFLIDKHGVIRHAVI

SEQ ID NO: 260 - protein, 20 aa, Artificial Sequence
  Made in a lab
TFLIDKHGVIRHAVINDLPL

SEQ ID NO: 261 - protein, 20 aa, Artificial Sequence
  Made in a lab
KHGVIRHAVINDLPLGRSID

SEQ ID NO: 262 - protein, 20 aa, Artificial Sequence
  Made in a lab
RHAVINDLPLGRSIDEELRI

SEQ ID NO: 263 - DNA, 897 bp, Chlamydia
  misc_feature (1)...(897): n = A,T,C or G
atggcttctatatgcggacgtttagggtctggtacagggaatgctctaaaagctttttttacacagcccaacaataaaatggcaagggtagtaaataagacgaagggagtggataagactattaaggttgccaagtctgctgccgaattgaccgcaaatattttggaacaagctggaggcgcgggctcttccgcacacattacagcttcccaagtgtccaaaggattaggggatgcgagaactgttgtcgctttagggaatgcctttaacggagcgttgccaggaacagttcaaagtgcgcaaagcttcttctctcacatgaaagctgctagtcagaaaacgcaagaaggggatgaggggctcacagcagatctttgtgtgtctcataagcgcagagcggctgcggctgtctgtagcatcatcggaggaattacctacctcgcgacattcggagctatccgtccgattctgtttgtcaacaaaatgctggcaaaaccgtttctttcttcccaaactaaagcaaatatgggatcttctgttagctatattatggcggctaaccatgcagcgtctgtggtgggtgctggactcgctatcagtgcgnaaagagcagattgcgaagcccgctgcgctcgtattgcgagagaagagtcgttactcgaagtgccgggagaggaaaatgcttgcgagaagaaagtcgctggagagaaagccaagacgttcacgcgcatcaagtatgcactcctcactatgctcgagaagtttttggaatgcgttgccgacgttttcaaattggtgccgctgcctattacaatgggtattcgtgcgattgtggctgctggatgtacgttcacttctgcaattattggattgtgcactttctgcgccagagcataa

SEQ ID NO: 264 - protein, 298 aa, Chlamydia
  VARIANT (1)...(298): Xaa = Any Amino Acid
MASICGRLGSGTGNALKAFFTQPNNKMARVVNKTKGVDKTIKVAKSAAELTANILEQAGGAGSSAHITASQVSKGLGDARTVVALGNAFNGALPGTVQSAQSFFSHMKAASQKTQEGDEGLTADLCVSHKRRAAAAVCSIIGGITYLATFGAIRPILFVNKMLAKPFLSSQTKANMGSSVSYIMAANHAASVVGAGLAISAXRADCEARCARIAREESLLEVPGEENACEKKVAGEKAKTFTRIKYALLTMLEKFLECVADVFKLVPLPITMGIRAIVAAGCTFTSAIIGLCTFCARA

SEQ ID NO: 265 - DNA, 897 bp, Chlamydia
  misc_feature (1)...(897): n = A,T,C or G
atggcttctatatgcggacgtttagggtctggtacagggaatgctctaaaagctttttttacacagcccaacaataaaatggcaagggtagtaaataagacgaagggaatggataagactattaaggttgccaagtctgctgccgaattgaccgcaaatattttggaacaagctggaggcgcgggctcttccgcacacattacagcttcccaagtgtccaaaggattaggggatgcgagaactgttgtcgctttagggaatgcctttaacggagcgttgccaggaacagttcaaagtgcgcaaagcttcttctctcacatgaaagctgctagtcagaaaacgcaagaaggggatgaggggctcacagcagatctttgtgtgtctcataagcgcagagcggctgcggctgtctgtagcatcatcggaggaattacctacctcgcgacattcggagctatccgtccgattctgtttgtcaacaaaatgctggcaaaaccgtttctttcttcccaaactaaagcaaatatgggatcttctgttagctatattatggcggctaaccatgcagcgtctgtggtgggtgctggactcgctatcagtgcgnaaagagcagattgcgaagcccgctgcgctcgtattgcgagagaagagtcgttactcgaagtgccgggagaggaaaatgcttgcgagaagaaagtcgctggagagaaagccaagacgttcacgcgcatcaagtatgcactcctcactatgctcgagaagtttttggaatgcgttgccgacgttttcaaattggtgccgctgcctattacaatgggtattcgtgcgattgtggctgctggatgtacgttcacttctgcaattattggattgtgcactttctgcgccagagcataa

SEQ ID NO: 266 - protein, 298 aa, Chlamydia
  VARIANT (1)...(298): Xaa = Any Amino Acid
MASICGRLGSGTGNALKAFFTQPNNKMARVVNKTKGMDKTIKVAKSAAELTANILEQAGGAGSSAHITASQVSKGLGDARTVVALGNAFNGALPGTVQSAQSFFSHMKAASQKTQEGDEGLTADLCVSHKRRAAAAVCSIIGGITYLATFGAIRPILFVNKMLAKPFLSSQTKANMGSSVSYIMAANHAASVVGAGLAISAXRADCEARCARIAREESLLEVPGEENACEKKVAGEKAKTFTRIKYALLTMLEKFLECVADVFKLVPLPITMGIRAIVAAGCTFTSAIIGLCTFCARA

SEQ ID NO: 267 - DNA, 680 bp, Chlamydia
tctatatccatattgataggaaaaaacgtcgcagaaagattttagctatgacgtttatccgagctttaggatattcaacagatgcagatattattgaagagttcttttctgtagaggagcgttccttacgttcagagaaggattttgtcgcgttagttggtaaagttttagctgataacgtagttgatgcggattcttcattagtttacgggaaagctggagagaagctaagtactgctatgctaaaacgcatcttagatacgggagtccaatctttgaagattgctgttggcgcagatgaaaatcacccaattattaagatgctcgcaaaagatcctacggattcttacgaagctgctcttaaagatttttatcgcagattacgaccaggagagcctgcaactttagctaatgctcgatccacaattatgcgtttattcttcgatgctaaacgttataatttaggccgcgttggacgttataaattaaataaaaaattaggcttcccattagacgacgaaacattatctcaagtgactttgagaaaagaagatgttatcggcgcgttgaaatatttgattcgtttgcgaatgggcgatgagaagacatctatcgatgatattgaccatttggcaaaccgacgagttcgctctgttggagaactaattcagaatcactgt

SEQ ID NO: 268 - DNA, 359 bp, Chlamydia
cttatgttctggagaatgttgcaacaacatattaatcgaaccagctcctcctagtaacatagaaaccaagcccttttgagaaaaaacctgtacttcgcatcctttagccatttgttgaatagctcctaacaaagagctaattttttcctcttccttgtttttctgaggcgctgtggactctaaatatagcaagtgctcttggaacacctcatcaacaatcgcttgtcctagattaggtatagagactgtctctccatcaattaaatggagtttcaaagtaatatccccttccgtccctccatcacaagactctatgaaagctatctgattccatcgagcagaaatgtatggggaaatac

SEQ ID NO: 269 - DNA, 124 bp, Chlamydia
gatcgaatcaattgagggagctcattaacaagaatagctgcagtttctttgcgttcttctggaataacaagaaataggtaatcggtaccattgatagaacgaacacgacaaatcgcagaaggtt

SEQ ID NO: 270 - DNA, 219 bp, Chlamydia
gatcctgttgggcctagtaataatacgttggatttcccataactcacttgtttatcctgcataagagcacggatacgcttatagtggttatagacggcaaccgaaatcgtttttttcgcgcgctcttgtccaatgacataagagtcgatgtggcgtttgatttctttaggggttaacactctcagacttgttggagagcttgtggaagatgttgcgatc

SEQ ID NO: 271 - DNA, 511 bp, Chlamydia
  misc_feature (1)...(511): n = A,T,C or G
ggatccgaattcggcacgaggagaaaatataggaggttccakcatcggaagatctaatagacaaagaggttttggcatagatggctcctccttgtacgttcaacgatgattgggagggattgttatcgatagcttggttcccagagaactgacaagtcccgctacattgagagaatgtaacctgttctccatagatagctcctcctactacacctgaataagttggtgttgctggagatgatggtgcggctgctgcggctgcttgtagggaagcagcagctgcagcaggtgctgaagctgttgttgcgactcctgtggatgaggagtttgctttgttgttcgagaaagagaagcctgatttcagattagaaatatttacagttttagcatgtaagcctccaccttctttcccaacaaggttctctgttacagataaggagactagangcatctagttttaaagattttttacagcagatacctccacctatctctgtagcggagttctcag

SEQ ID NO: 272 - DNA, 598 bp, Chlamydia
ctcttcctctcctcaatctagttctggagcaactacagtctccgactcaggagactctagctctggctcaaactcggatacctcaaaaacagttccagtcacagctaaaggcggtgggctttatactgataagaatctttcgattactaacatcacaggaattatcgaaattgcaaataacaaagcgacagatgttggaggtggtgcttacgtaaaaggaacccttacttgtaaaaactctcaccgtctacaatttttgaaaaactcttccgataaacaaggtggaggaatctacggagaagacaacatcaccctatctaatttgacagggaagactctattccaagagaatactgccaaaaaagagggcggtggactcttcataaaaggtacagataaagctcttacaatgacaggactggatagtttctgtttaattaataacacatcagaaaaacatggtggtgggagcctttgttaccaaagaaatctctcagacttacacctcttgatgtggaaacaattccaggaatcacgcctgtacatggtgaaacagtcattactggcaataaatctacaggaggtaatggtggagggc

SEQ ID NO: 273 - DNA, 126 bp, Chlamydia
ggatccgaattcggcacgagatgagccttatagtttaacaaaagcttctcacattccttcgatagctttttattagccgtttttagcatcctaatgagatctcctcgttcgtaacaaatacgagag

SEQ ID NO: 274 - DNA, 264 bp, Chlamydia
ggatccgaattcggcacgagctcttttaaatcttaattacaaaaagacaaattaattcaatttttcaaaaaagaatttaaacattaattgttgtaaaaaaacaatatttattctaaaataataaccatagttacgggggaatctctttcatggtttattttagagctcatcaacctaggcatacgcctaaaacatttcctttgaaagttcaccattcgttctccgataagcatcctcaaattgctaaagctatgtggattacgg

SEQ ID NO: 275 - DNA, 359 bp, Chlamydia
ggatccgaattcggcacgagataaaacctgaaccacaacaaagatctaaaacttcttgattttcagctgcaaattcttttagataaatatcaaccatttcttcagtttcatatcttggaattaaaacttgttctcttaaattaattctagtatttaagtattcaacatagcccattattaattgaattggataattttgccttaataattcacattctttttcagtaattttaggttctaaaccgtaccgctttttttctaaaattaatgtttcttcattattcattttataagccactttcctttattttttgattttgttcttctgttagtaatgcttcaataatagttaataattt

SEQ ID NO: 276 - DNA, 357 bp, Chlamydia
aaaacaattgatataattttttttttcataacttccagactcctttctagaaaagtctttatgggtagtagtgactctaacgttttttattattaagacgatccccggagatccttttaatgatgaaaacggaaacatcctttcgccagaaactttagcactattaaagaatcgttacgggttagataagcctttattcacccagtatcttatctatttgaaatgtctgctaacactagatttcggggaatctcttatctacaaagatcgaaatctcagcattattgctgccgctcttccatcttccgctattcttggacttgaaagcttgtgtttactcgtgccgaattcggatcc

SEQ ID NO: 277 - DNA, 505 bp, Chlamydia
ggatccgaattcggcacgagctcgtgccgattgcttgcttcagtcaccccatcggtatagagcactaaaagagactcctcttcaagaacgagagtgtaagcagggtgaggaggaacttcaggtaaaaatcctaaggccataccaggatgcgacaggaaagagatatctccattaggagctcggagacacgctgggttgtggccacaagaatagtattctagttctcgtgttgcgtaatgataacaataaatgcatagtgttacaaacatcccagattcagctgtctgttgatagaagagagcagctgtttgttgaacggcttcttgaatagaggagagctcactcaaaaaggtatgtaacatgtttttcaggaataaggagtaggcgcacgcattgactcctttcccggaagcatcagcaacgattagaaagagtttagcttggggaccttcgcctataacaaagatatcaaagaaatctcctcctaccgtaactgcaggaatat

SEQ ID NO: 278 - DNA, 407 bp, Chlamydia
ggatccgaattcggcacgagaactactgagcaaattgggtatccaacttcctctttacgaaagaaaaacagaaggcattctccataccaagatttgttgcatcgacaataaaactccaatctttggctctgctaactggagcggtgctggtatgattaaaaactttgaagacctattcatccttcgcccaattacagagacacagcttcaggcctttatggacgtctggtctcttctagaaacaaatagctcctatctgtccccagagagcgtgcttacggcccctactccttcaagtagacctactcaacaagatacagattctgatgacgaacaaccgagtaccagccagcaagctatccgtatgagaaaataggattagggaaacaaaacgacagcaaaccaca

SEQ ID NO: 279 - DNA, 351 bp, Chlamydia
ctcgtgccgcttacaggaggcttgtatcctttaaaatagagtttttcttatgaccccatgtggcgataggccgggtctagcgccgatagtagaaatatcggttggtttttgtccttgaggggatcgtatactttttcaaagtatggtccccgtatcgattatctggaggctcttatgtctttttttcatactagaaaatataagcttatcctcagaggactcttgtgtttagcaggctgtttcttaatgaacagctgttcctctagtcgaggaaatcaacccgctgatgagagcatctatgtcttgtctatgaatcgcatgatttgtgattctcgtgccgaattcggatcc

SEQ ID NO: 280 - DNA, 522 bp, Chlamydia
ggatccgaattcggcacgagcagaggaaaaaggcgatactcctcttgaagatcgtttcacagaagatctttccgaagtctctggagaagattttcgaggattgaaaaattcgttcgatgatgattcttcttctgacgaaattctcgatgcgctcacaagtaaattttctgatcccacaataaaggatctagctcttgattatctaattcaaatagctccctctgatgggaaacttaagtccgctctcattcaggcaaagcatcaactgatgagccagaatcctcaggcgattgttggaggacgcaatgttctgttagcttcagaaacctttgcttccagagcaaatacatctccttcatcgcttcgctccttatatttccaagtaacctcatccccctctaattgcgctaatttacatcaaatgcttgcttcttactcgccatcagagaaaaccgctgttatggagtttctagtgaatggcatggtagcagatttaaaatcggagggcccttccattcctcc

SEQ ID NO: 281 - DNA, 577 bp, Chlamydia
ggatccgaattcggcacgagatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaat

SEQ ID NO: 282 - DNA, 607 bp, Chlamydia
actmatcttccccgggctcgagtgcggccgcaagcttgtcgacggagctcgatacaaaaatgtgtgcgtgtgaaccgcttcttcaaaagcttgtcttaaaagatattgtctcgcttccggattagttacatgtttaaaaattgctagaacaatattattcccaaccaagctctctgcggtgctgaaaaaacctaaattcaaaagaatgactcgccgctcatcttcagaaagacgatccgacttccataattcgatgtctttccccatggggatctctgtagggagccagttatttgcgcagccattcaaataatgttcccaagcccatttgtacttaataggaacaagttggttgacatcgacctggttgcagttcactagacgcttgctatttagattaacgcgtttctgttttccatctaaaatatctgcttgcataagaaccgttaattttattgttaatttatatgattaattactgacatgcttcacacccttcttccaaagaacagacaggtgctttcttcgctctttcaacaataattcctgccgaagcagacttattcttcatccaacgaggctgaattcctctcttattaatatctac

SEQ ID NO: 283 - DNA, 1077 bp, Chlamydia
ggatccgaattcggcacgagaagttaacgatgacgatttgttcctttggtagagaaggagcaatcgaaactaaatgtgcgagagcatgtgaagactccaatgcaggaataatcccctcatttctagtaagcaggaaaaaagctcgtaacgcctcttcatcggtggctaatgtataaaaggctcgtcctgactcatgcatttcggcatgatctggcccaactgaaggataatctaatccagcggaaatggagtgagtttgtaatacttgtccatcgtcatcttgaagaagatacgaataaaatccgtggaatactccaggtcgccctgttgcaaaacgtgctgcatgttttcctgaagaaatgcccagtcctcccccttccactccaattaattggacttttggattcgggataaaatgatggaaaaatccaatagcgttggagccacctccgatacatgcaatcagaatatcaggatctcttcctgcaactgcatggatttgctctttcacttcagcgcttataacagactgaaaaaatcgaacgatatcgggataaggtaaaggtcctaaggccgatcctaagcaatagtgagtaaatgagtgtgttgttgcccaatcttgtagagcttgattaactgcatctttgagtccacaagatccttttgttacagaaacgacttcagcacctaaaaagcgcattttctctacatttggtttctgtcgttccacatcttttgctcccatgtatactacacaatctaatcctagataagcacacgctgttgctgttgctactccatgttgtcccgcacctgtttcagctacaacacgtgttttcccaagatatttagcaagcaaacactgaccaagagcattattcagtttatgtgctcctgtatgcaaaagatcttcgcgtttaagaaatactctagggccatcaatagctcgagcaaaattcttaacttcagtcagaggagtttgtctccccgcatagtttttcaaaatacaatctagttcagataaaaaactttgctgagttttgagaatctcccattccgcttttagattctgtatag

SEQ ID NO: 284 - DNA, 407 bp, Chlamydia; identical to SEQ ID NO: 278

SEQ ID NO: 285 - DNA, 802 bp, Chlamydia
ggatccgaattcggcacgagttagcttaatgtctttgtcatctctacctacatttgcagctaattctacaggcacaattggaatcgttaatttacgtcgctgcctagaagagtctgctcttgggaaaaaagaatctgctgaattcgaaaagatgaaaaaccaattctctaacagcatggggaagatggaggaagaactgtcttctatctattccaagctccaagacgacgattacatggaaggtctatccgagaccgcagctgccgaattaagaaaaaaattcgaagatctatctgcagaatacaacacagctcaagggcagtattaccaaatattaaaccaaagtaatctcaagcgcatgcaaaagattatggaagaagtgaaaaaagcttctgaaactgtgcgtattcaagaaggcttgtcagtccttcttaacgaagatattgtcttatctatcgatagttcggcagataaaaccgatgctgttattaaagttcttgatgattcttttcaaaataattaacatgcgaagctagccgaggagtgccgtatgtctcaatccacttattctcttgaacaattagctgattttttgaaagtcgagtttcaaggaaatggagctactcttctttccggagttgaagagatcgaggaagcaaaaacggcacacatcacattcttagataatgaaaaatatgctaaacatttaaaatcatcggaagctggcgctatcatcatatctcgaacacagtttcaaaaatatcgagacttgaataaaaactttcttatcacttctgagtct

SEQ ID NO: 286 - DNA, 588 bp, Chlamydia
ggatccgaattcggcacgaggcaatatttactcccaacattacggttccaaataagcgataaggtcttctaataaggaagttaatgtaagaggcttttttattgcttttcgtaaggtagtattgcaaccgcacgcgattgaatgatacgcaagccatttccatcatggaaaagaacccttggacaaaaatacaaaggaggttcactcctaaccagaaaaagggagagttagtttccatgggttttccttatatacacccgtttcacacaattaggagccgcgtctagtatttggaatacaaattgtccccaagcgaattttgttcctgtttcagggatttctcctaattgttctgtcagccatccgcctatggtaacgcaattagctgtagtaggaagatcaactccaaacaggtcatagaaatcagaaagctcataggtgcctgcagcaataacaacattcttgtctgagtgagcgaattgtttaaaagatgggcgattatgagctacctcatcagagactattttaaatagatcattttgggtaatcaatccttctatagacccatattcatcaatgataatctcg

SEQ ID NO: 287 - DNA, 489 bp, Chlamydia
  misc_feature (1)...(489): n = A,T,C or G
agtgcctattgttttgcaggctttgtctgatgatagcgataccgtacgtgagattgctgtacaagtagctgttatgtatggttctagttgcttactgcgcgccgtgggcgatttagcgaaaaatgattcttctattcaagtacgcatcactgcttatcgtgctgcagccgtgttggagatacaagatcttgtgcctcatttacgagttgtagtccaaaatacacaattagatggaacggaaagaagagaagcttggagatctttatgtgttcttactcggcctcatagtggtgtattaactggcatagatcaagctttaatgacctgtgagatgttaaaggaatatcctgaaaagtgtacggaagaacagattcgtacattattggctgcagatcatccagaagtgcaggtagctactttacagatcattctgagaggaggtagagtattccggtcatcttctataatggaatcggttctcgtgccgnt

SEQ ID NO: 288 - DNA, 191 bp, Chlamydia
ggatccgaattcaggatatgctgttgggttatcaataaaaagggttttgccattttttaagacgactttgtagataacgctaggagctgtagcaataatatcgagatcaaattctctagagattctctcaaagatgatttctaagtgcagcagtcctaaaaatccacagcggaacccaaatccgagagagt

SEQ ID NO: 289 - DNA, 515 bp, Chlamydia
ggatccgaattcggcacgaggagcgacgtgaaatagtggaatcttcccgtattcttattacttctgcgttgccttacgcaaatggtcctttgcattttggacatattaccggtgcttatttgcctgcagatgtttatgcgcgttttcagagactacaaggcaaagaggttttgtatatttgtggttctgatgaatacggaatcgcaattacccttaatgcagagttggcaggcatggggtatcaagaatatgtcgacatgtatcataagcttcataaagataccttcaagaaattgggaatttctgtagatttcttttccagaactacgaacgcttatcatcctgctattgtgcaagatttctatcgaaacttgcaggaacgcggactggtagagaatcaggtgaccgaacagctgtattctgaggaagaagggaagtttttagcggaccgttatgttgtaggtacttgtcccaagtgtgggtttgatcgagctcgaggagatgagtgtcagcag

SEQ ID NO: 290 - DNA, 522 bp, Chlamydia
ggatccgaattcggcacgagggaggaatggaagggccctccgattktamatctgctaccatgccattcactagaaactccataacagcggttttctctgatggcgagtaagaagcaagcatttgatgtaaattagcgcaattagagggggatgaggttacttggaaatataaggagcgaagcgatgaaggagatgtatttgctctggaagcaaaggtttctgaagctaacagaacattgcgtcctccaacaatcgcctgaggattctggctcatcagttgatgctttgcctgaatgagagcggacttaagtttcccatcagagggagctatttgaattagataatcaagagctagatcctttattgtgggatcagaaaatttacttgtgagcgcatcgagaatttcgtcagaagaagaatcatcatcgaacgaatttttcaatcctcgaaaatcttctccagagacttcggaaagatcttctgtgaaacgatcttcaagaggagtatcgcctttttccyctg

SEQ ID NO: 291 - DNA, 1002 bp, Chlamydia
atggcgactaacgcaattagatcggcaggaagtgcagcaagtaagatgctgctgccagttgccaaagaaccagcggctgtcagctcctttgctcagaaagggatttattgtattcaacaattttttacaaaccctgggaataagttagcaaagtttgtaggggcaacaaaaagtttagataaatgctttaagctaagtaaggcggtttctgactgtgtcgtaggatcgctggaagaggcgggatgcacaggggacgcattgacctccgcgagaaacgcccagggtatgttaaaaacaactcgagaagttgttgccttagctaatgtgctcaatggagctgttccatctatcgttaactcgactcagaggtgttaccaatacacacgtcaagccttcgagttaggaagcaagacaaaagaaagaaaaacgcctggggagtatagtaaaatgctattaactcgaggtgattacctattggcagcttccagggaagcttgtacggcagtcggtgcaacgacttactcagcgacattcggtgttttacgtccgttaatgttaatcaataaactcacagcaaaaccattcttagacaaagcgactgtaggcaattttggcacggctgttgctggaattatgaccattaatcatatggcaggagttgctggtgctgttggcggaatcgcattagaacaaaagctgttcaaacgtgcgaaggaatccctatacaatgagagatgtgccttagaaaaccaacaatctcagttgagtggggacgtgattctaagcgcggaaagggcattacgtaaagaacacgttgctactctaaaaagaaatgttttaactcttcttgaaaaagctttagagttggtagtggatggagtcaaactcattcctttaccgattacagtggcttgctccgctgcaatttctggagccttgacggcagcatccgcaggaattggcttatatagcatatggcagaaaacaaagtctggcaaataa

SEQ ID NO: 292 - protein, 333 aa, Chlamydia
MATNAIRSAGSAASKMLLPVAKEPAAVSSFAQKGIYCIQQFFTNPGNKLAKFVGATKSLDKCFKLSKAVSDCVVGSLEEAGCTGDALTSARNAQGMLKTTREVVALANVLNGAVPSIVNSTQRCYQYTRQAFELGSKTKERKTPGEYSKMLLTRGDYLLAASREACTAVGATTYSATFGVLRPLMLINKLTAKPFLDKATVGNFGTAVAGIMTINHMAGVAGAVGGIALEQKLFKRAKESLYNERCALENQQSQLSGDVILSAERALRKEHVATLKRNVLTLLEKALELVVDGVKLIPLPITVACSAAISGALTAASAGIGLYSIWQKTKSGK

SEQ ID NO: 293 - DNA, 7 bp, Chlamydia
tgcaatc

SEQ ID NO: 294 - protein, 196 aa, Chlamydia
TMGSLVGRQAPDFSGKAVVCGEEKEISLADFRGKYVVLFFYPKDFTYVCPTELHAFQDRLVDFEEHGAVVLGCSVDDIETHSRWLTVARDAGGIEGTEYPLLADPSFKISEAFGVLNPEGSLALRATFLIDKHGVIRHAVINDLPLGRSIDEELRILDSLIFFENHGMVCPANWRSGERGMVPSEEGLKEYFQTMD

SEQ ID NO: 295 - protein, 181 aa, Chlamydia
KGGKMSTTISGDASSLPLPTASCVETKSTSSSTKGNTCSKILDIALAIVGALVVVAGVLALVLCASNVIFTVIGIPALIIGSACVGAGISRLMYRSSYASLEAKNVLAEQRLRNLSEEKDALASVSFINKMFLRGLTDDLQALEAKVMEFEIDCLDRLEKNEQALLSDVRLVLSSYTRWLD

SEQ ID NO: 296 - protein, 124 aa, Chlamydia
IYEVMNMDLETRRSFAVQQGHYQDPRASDYDLPRASDYDLPRSPYPTPPLPSRYQLQNMDVEAGFREAVYASFVAGMYNYVVTQPQERIPNSQQVEGILRDMLTNGSQTFSNLMQRWDREVDRE

SEQ ID NO: 297 - protein, 488 aa, Chlamydia
KGSLPILGPFLNGKMGFWRTSIMKMNRIWLLLLTFSSAIHSPVRGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGF

SEQ ID NO: 298 - protein, 140 aa, Chlamydia
RIDISSVTFFIGILLAVNALTYSHVLRDLSVSMDALFSRNTLAVLLGLVSSVLDNVPLVAATIGMYDLPMNDPLWKLIAYTAGTGGSILIIGSAAGVAYMGMEKVSFGWYVKHASWIALASYFGGLAVYFLMENCVNLFV

SEQ ID NO: 299 - protein, 361 aa, Chlamydia
HQEIADSPLVKKAEEQINQAQQDIQTITPSGLDIPIVGPSGSAASAGSAAGALKSSNNSGRISLLLDDVDNEMAAIAMQGFRSMIEQFNVNNPATAKELQAMEAQLTAMSDQLVGADGELPAEIQAIKDALAQALKQPSADGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQANQEEIMQKLTASISKAPQFGYPAVQNSVDSLQKFAAQLEREFVDGERSLAESQENAFRKQPAFIQQVLVNIASLFSGYLS

SEQ ID NO: 300 - protein, 207 aa, Chlamydia
SSKIVSLCEGAVADARMCKAELIKKEADAYLFCEKSGIYLTKKEGILIPSAGIDESNTDQPFVLYPKDILGSCNRIGEWLRNYFRVKELGVIITDSHTTPMRRGVLGIGLCWYGFSPLHNYIGSLDCFGRPLQMTQSNLVDALAVAAVVCMGEGNEQTPLAVIEQAPNMVYHSYPTSREEYCSLRIDETEDLYGPFLQAVTWSQEKK

SEQ ID NO: 301 - protein, 183 aa, Chlamydia
IPPAPRGHPQIEVTFDIDANGILHVSAKDAASGREQKIRIEASSGLKEDEIQQMIRDAELHKEEDKQRKEASDVKNEADGMIFRAEKAVKDYHDKIPAELVKEIEEHIEKVRQAIKEDASTTAIKAASDELSTRMQKIGEAMQAQSASAAASSAANAQGGPNINSEDLKKHSFSTRPPAGGSA

SEQ ID NO: 302 - protein, 232 aa, Chlamydia
MTKHGKRIRGIQETYDLAKSYSLGEAIDILKQCPTVRFDQTVDVSVKLGIDPRKSDQQIRGSVSLPHGTGKVLRILVFAAGDKAAEAIEAGADFVGSDDLVEKIKGGWVDFDVAVATPDMMREVGKLGKVLGPRNLMPTPKAGTVTTDVVKTIAELRKGKIEFKADRAGVCNVGVAKLSFDSAQIKENVEALCAALVKAKPATAKGQYLVNFTISSTMGPGVTVDTRELIAL

SEQ ID NO: 303 - protein, 238 aa, chlamydia
INSKLETKNLIYLKLKIKKSFKMGNSGFYLYNTQNCVFADNIKVGQMTEPLKDQQIILGTTSTPVAAKMTASDGISLTVSNNPSTNASITIGLDAEKAYQLILEKLGDQILGGIADTIVDSTVQDILDKITTDPSLGLLKAFNNFPITNKIQCNGLFTPRNIETLLGGTEIGKFTVTPKSSGSMFLVSADIIASRMEGGVVLALVREGDSKPYAISYGYSSGVPNLCSLRTRIINTGL

SEQ ID NO: 304 - protein, 133 aa, Chlamydia
HMHHHHHHMASICGRLGSGTGNALKAFFTQPSNKMARVVNKTKGMDKTVKVAKSAAELTANILEQAGGAGSSAHITASQVSKGLGDTRTVVALGNAFNGALPGTVQSAQSFFSHMKAASQKTQEGDEGLTADL

SEQ ID NO: 305 - protein, 125 aa, Chlamydia
MASICGRLGSGTGNALKAFFTQPSNKMARVVNKTKGMDKTVKVAKSAAELTANILEQAGGAGSSAHITASQVSKGLGDTRTVVALGNAFNGALPGTVQSAQSFFSHMKAASQKTQEGDEGLTADL

SEQ ID NO: 306 - DNA, 38 bp, Chlamydia trachomatis
gagagcggccgctcatgtttataacaaaggaacttatg

SEQ ID NO: 307 - DNA, 39 bp, Chlamydia trachomatis
gagagcggccgcttacttaggtgagaagaagggagtttc

SEQ ID NO: 308 - DNA, 1860 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcatgtttataacaaaggaacttatgaatcgagttatagaaatccatgctcactacgatcaaagacaactttctcaatctccaaatacaaacttcttagtacatcatccttatcttactcttattcccaagtttctactaggagctctaatcgtctatgctccttattcgtttgcagaaatggaattagctatttctggacataaacaaggtaaagatcgagatacctttaccatgatctcttcctgtcctgaaggcactaattacatcatcaatcgcaaactcatactcagtgatttctcgttactaaataaagtttcatcagggggagcctttcggaatctagcagggaaaatttccttcttaggaaaaaattcttctgcgtccattcattttaaacacattaatatcaatggttttggagccggagtcttttctgaatcctctattgaatttactgatttacgaaaacttgttgcttttggatctgaaagcacaggaggaatttttactgcgaaagaggacatctcttttaaaaacaaccaccacattgccttccgcaataatatcaccaaagggaatggtggcgttatccagctccaaggagatatgaaaggaagcgtatcctttgtagatcaacgtggagctatcatctttaccaataaccaagctgtaacttcttcatcaatgaaacatagtggtcgtggaggagcaattagcggtgacttcgcaggatccagaattctttttcttaataaccaacaaattactttcgaaggcaatagcgctgtgcatggaggtgctatctacaataagaatggccttgtcgagttcttaggaaatgcaggacctcttgcctttaaagagaacacaacaatagctaacgggggagctatatacacaagtaatttcaaagcgaatcaacaaacatcccccattctattctctcaaaatcatgcgaataagaaaggcggagcgatttacgcgcaatatgtgaacttagaacagaatcaagatactattcgctttgaaaaaaataccgctaaagaaggcggtggagccatcacctcttctcaatgctcaattactgctcataataccatcactttttccgataatgctgccggagatcttggaggaggagcaattcttctagaagggaaaaaaccttctctaaccttgattgctcatagtggtaatattgcatttagcggcaataccatgcttcatatcaccaaaaaagcttccctagatcgacacaattctatcttaatcaaagaagctccctataaaatccaacttgcagcgaacaaaaaccattctattcatttctttgatcctgtcatggcattgtcagcatcatcttcccctatacaaatcaatgctcctgagtatgaaactcccttcttctcacctaagtaa

SEQ ID NO: 309 - protein, 619 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLMFITKELMNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTITFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPK

SEQ ID NO: 310 - DNA, 39 bp, Chlamydia trachomatis
gagagcggccgctccattctattcatttctttgatcctg

SEQ ID NO: 311 - DNA, 33 bp, Chlamydia trachomatis
gagagcggccgcttagaagccaacatagcctcc

SEQ ID NO: 312 - DNA, 2076 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctccattctattcatttctttgatcctgtcatggcattgtcagcatcatcttcccctatacaaatcaatgctcctgagtatgaaactcccttcttctcacctaagggtatgatcgttttctcgggtgcgaatcttttagatgatgctagggaagatgttgcaaatagaacatcgatttttaaccaacccgttcatctatataatggcaccctatctatcgaaaatggagcccatctgattgtccaaagcttcaaacagaccggaggacgtatcagtttatctccaggatcctccttggctctatacacgatgaactcgttcttccatggcaacatatccagcaaagaacccctagaaattaatggtttaagctttggagtagatatctctccttctaatcttcaagcagagatccgtgccggcaacgctcctttacgattatccggatccccatctatccatgatcctgaaggattattctacgaaaatcgcgatactgcagcatcaccataccaaatggaaatcttgctcacctctgataaaactgtagatatctccaaatttactactgattctctagttacgaacaaacaatcaggattccaaggagcctggcattttagctggcagccaaatactataaacaatactaaacaaaaaatattaagagcttcttggctcccaacaggagaatatgtccttgaatccaatcgagtggggcgtgccgttcctaattccttatggagcacatttttacttttacagacagcctctcataacttaggcgatcatctatgtaataatcgatctcttattcctacttcatacttcggagttttaattggaggaactggagcagaaatgtctacccactcctcagaagaagaaagctttatatctcgtttaggagctacaggaacctctatcatacgcttaactccctccctgacactctctggaggaggctcacatatgttcggagattcgttcgttgcagacttaccagaacacatcacttcagaaggaattgttcagaatgtcggtttaacccatgtctggggaccccttactgtcaattctacattatgtgcagccttagatcacaacgcgatggtccgcatatgctccaaaaaagatcacacctatgggaaatgggatacattcggtatgcgaggaacattaggagcctcttatacattcctagaatatgatcaaactatgcgcgtattctcattcgccaacatcgaagccacaaatatcttgcaaagagcttttactgaaacaggctataacccaagaagtttttccaagacaaaacttctaaacatcgccatccccatagggattggttatgaattctgcttagggaatagctcttttgctctactaggtaagggatccatcggttactctcgagatattaaacgagaaaacccatccactcttgctcacctggctatgaatgattttgcttggactaccaatggctgttcagttccaacctccgcacacacattggcaaatcaattgattcttcgctataaagcatgttccttatacatcacggcatatactatcaaccgtgaagggaagaacctctccaatagcttatcctgcggaggctatgttggcttctaa

SEQ ID NO: 313 - protein, 691 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 314 - DNA, 38 bp, Chlamydia trachomatis
gagagcggccgctcatgattaaaagaacttctctatcc

SEQ ID NO: 315 - DNA, 36 bp, Chlamydia trachomatis
agcggccgcttataattctgcatcatcttctatggc

SEQ ID NO: 316 - DNA, 1941 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcatgattaaaagaacttctctatcctttgcttgcctcagttttttttatctttcaactatatccattttgcaagctaatgaaacggatacgctacagttccggcgatttactttttcggatagagagattcagttcgtcctagatcccgcctctttaattaccgcccaaaacatcgttttatctaatttacagtcaaacggaaccggagcctgtaccatttcaggcaatacgcaaactcaaatcttttctaattccgttaacaccaccgcagattctggtggagcctttgatatggttactacctcattcacggcctctgataatgctaatctactcttctgcaacaactactgcacacataataaaggcggaggagctattcgttccggaggacctattcgattcttaaataatcaagacgtgcttttttataataacatatcggcaggggctaaatatgttggaacaggagatcacaacgaaaaaaataggggcggtgcgctttatgcaactactatcactttgacagggaatcgaactcttgcctttattaacaatatgtctggagactgcggtggagccatctctgctgacactcaaatatcaataactgataccgttaaaggaattttatttgaaaacaatcacacgctcaatcatataccgtacacgcaagctgaaaatatggcacgaggaggagcaatctgtagtagaagagacttgtgctcaatcagcaataattctggtcccatagtttttaactataaccaaggcgggaaaggtggagctattagcgctacccgatgtgttattgacaataacaaagaaagaatcatcttttcaaacaatagttccctgggatggagccaatcttcttctgcaagtaacggaggagccattcaaacgacacaaggatttactttacgaaataataaaggctctatctacttcgacagcaacactgctacacacgccgggggagccattaactgtggttacattgacatccgagataacggacccgtctattttctaaataactctgctgcctggggagcggcctttaatttatcgaaaccacgttcagcgacaaattatatccatacagggacaggcgatattgtttttaataataacgttgtctttactcttgacggtaatttattagggaaacggaaactttttcatattaataataatgagataacaccatatacattgtctctcggcgctaaaaaagatactcgtatctatttttatgatcttttccaatgggagcgtgttaaagaaaatactagcaataacccaccatctcctaccagtagaaacaccattaccgttaacccggaaacagagttttctggagctgttgtgttctcctacaatcaaatgtctagtgacatacgaactctgatgggtaaagaacacaattacattaaagaagccccaactactttaaaattcggaacgctagccatagaagatgatgcagaattataa

SEQ ID NO: 317 - protein, 646 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLMIKRTSLSFACLSFFYLSTISILQANETDTLQFRRFTFSDREIQFVLDPASLITAQNIVLSNLQSNGTGACTISGNTQTQIFSNSVNTTADSGGAFDMVTTSFTASDNANLLFCNNYCTHNKGGGAIRSGGPIRFLNNQDVLFYNNISAGAKYVGTGDHNEKNRGGALYATTITLTGNRTLAFINNMSGDCGGAISADTQISITDTVKGILFENNHTLNHIPYTQAENMARGGAICSRRDLCSISNNSGPIVFNYNQGGKGGAISATRCVIDNNKERIIFSNNSSLGWSQSSSASNGGAIQTTQGFTLRNNKGSIYFDSNTATHAGGAINCGYIDIRDNGPVYFLNNSAAWGAAFNLSKPRSATNYIHTGTGDIVFNNNVVFTLDGNLLGKRKLFHINNNEITPYTLSLGAKKDTRIYFYDLFQWERVKENTSNNPPSPTSRNTITVNPETEFSGAVVFSYNQMSSDIRTLMGKEHNYIKEAPTTLKFGTLAIEDDAEL

SEQ ID NO: 318 - DNA, 34 bp, Chlamydia trachomatis
gagagcggccgctcgacatacgaactctgatggg

SEQ ID NO: 319 - DNA, 33 bp, Chlamydia trachomatis
gagagcggccgcttaaaagaccagagctcctcc

SEQ ID NO: 320 - DNA, 2148 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcgacatacgaactctgatgggtaaagaacacaattacattaaagaagccccaactactttaaaattcggaacgctagccatagaagatgatgcagaattagaaatcttcaatatcccgtttacccaaaatccgactagccttcttgctttaggaagcggcgctacgctgactgttggaaagcacggtaagctcaatattacaaatcttggtgttattttacccattattctcaaagaggggaagagtccgccttgtattcgcgtcaacccacaagatatgacccaaaatactggtaccggccaaactccatcaagcacaagtagtataagcactccaatgattatctttaatgggcgcctctcaattgtagacgaaaattatgaatcagtctacgacagtatggacctctccagagggaaagcagaacaactaattctatccatagaaaccactaatgatgggcaattagactccaattggcaaagttctctgaatacttctctactctctcctccacactatggctatcaaggtctatggactcctaattggataacaacaacctataccatcacgcttaataataattcttcagctccaacatctgctacctccatcgctgagcagaaaaaaactagtgaaacttttactcctagtaacacaactacagctagtatccctaatattaaagcttccgcaggatcaggctctggatcggcttccaattcaggagaagttacgattaccaaacatacccttgttgtaaactgggcaccagtcggctacatagtagatcctattcgtagaggagatctgatagccaatagcttagtacattcaggaagaaacatgaccatgggcttacgatcattactcccggataactcttggtttgctttgcaaggagctgcaacaacattatttacaaaacaacaaaaacgtttgagttatcatggctactcttctgcatcaaaggggtataccgtctcttctcaagcatcaggagctcatggtcataagtttcttctttccttctcccagtcatctgataagatgaaagaaaaagaaacaaataaccgcctttcttctcgttactatctttctgctttatgtttcgaacatcctatgtttgatcgcattgctcttatcggagcagcagcttgcaattatggaacacataacatgcggagtttctatggaactaaaaaatcttctaaagggaaatttcactctacaaccttaggagcttctcttcgctgtgaactacgcgatagtatgcctttacgatcaataatgctcaccccatttgctcaggctttattctctcgaacagaaccagcttctatccgagaaagcggtgatctagctagattatttacattagagcaagcccatactgccgttgtctctccaataggaatcaaaggagcttattcttctgatacatggccaacactctcttgggaaatggaactagcttaccaacccaccctctactggaaacgtcctctactcaacacactattaatccaaaataacggttcttgggtcaccacaaataccccattagctaaacattccttttatgggagaggttctcactccctcaaattttctcatctgaaactatttgctaactatcaagcagaagtggctacttccactgtctcacactacatcaatgcaggaggagctctggtcttttaa

SEQ ID NO: 321 - protein, 715 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLDIRTLMGKEHNYIKEAPTTLKFGTLAIEDDAELEIFNIPFTQNPTSLLALGSGATLTVGKHGKLNITNLGVILPIILKEGKSPPCIRVNPQDMTQNTGTGQTPSSTSSISTPMIIFNGRLSIVDENYESVYDSMDLSRGKAEQLILSIETTNDGQLDSNWQSSLNTSLLSPPHYGYQGLWTPNWITTTYTITLNNNSSAPTSATSIAEQKKTSETFTPSNTTTASIPNIKASAGSGSGSASNSGEVTITKHTLVVNWAPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRLSSRYYLSALCFEHPMFDRIALIGAAACNYGTHNMRSFYGTKKSSKGKFHSTTLGASLRCELRDSMPLRSIMLTPFAQALFSRTEPASIRESGDLARLFTLEQAHTAVVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 322 - DNA, 37 bp, Chlamydia trachomatis
gagagcggccgctcatgcctttttctttgagatctac

SEQ ID NO: 323 - DNA, 36 bp, Chlamydia trachomatis
gagagcggccgcttacacagatccattaccggactg

SEQ ID NO: 324 - DNA, 1896 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcatgcctttttctttgagatctacatcattttgttttttagcttgtttgtgttcctattcgtatggattcgcgagctctcctcaagtgttaacacctaatgtaaccactccttttaagggggacgatgtttacttgaatggagactgcgcttttgtcaatgtctatgcaggggcagagaacggctcaattatctcagctaatggcgacaatttaacgattaccggacaaaaccatacattatcatttacagattctcaagggccagttcttcaaaattatgccttcatttcagcaggagagacacttactctgaaagatttttcgagtttgatgttctcgaaaaatgtttcttgcggagaaaagggaatgatctcagggaaaaccgtgagtatttccggagcaggcgaagtgattttttgggataactctgtggggtattctcctttgtctattgtgccagcatcgactccaactcctccagcaccagcaccagctcctgctgcttcaagctctttatctccaacagttagtgatgctcggaaagggtctattttttctgtagagactagtttggagatctcaggcgtcaaaaaaggggtcatgttcgataataatgccgggaattttggaacagtttttcgaggtaatagtaataataatgctggtagtgggggtagtgggtctgctacaacaccaagttttacagttaaaaactgtaaagggaaagtttctttcacagataacgtagcctcctgtggaggcggagtagtctacaaaggaactgtgcttttcaaagacaatgaaggaggcatattcttccgagggaacacagcatacgatgatttagggattcttgctgctactagtcgggatcagaatacggagacaggaggcggtggaggagttatttgctctccagatgattctgtaaagtttgaaggcaataaaggttctattgtttttgattacaactttgcaaaaggcagaggcggaagcatcctaacgaaagaattctctcttgtagcagatgattcggttgtctttagtaacaatacagcagaaaaaggcggtggagctatttatgctcctactatcgatataagcacgaatggaggatcgattctgtttgaaagaaaccgagctgcagaaggaggcgccatctgcgtgagtgaagcaagctctggttcaactggaaatcttactttaagcgcttctgatggggatattgttttttctgggaatatgacgagtgatcgtcctggagagcgcagcgcagcaagaatcttaagtgatggaacgactgtttctttaaatgcttccggactatcgaagctgatcttttatgatcctgtagtacaaaataattcagcagcgggtgcatcgacaccatcaccatcttcttcttctatgcctggtgctgtcacgattaatcagtccggtaatggatctgtgtaa

SEQ ID NO: 325 - protein, 631 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLMPFSLRSTSFCFLACLCSYSYGFASSPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSIVPASTPTPPAPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSV

SEQ ID NO: 326 - DNA, 40 bp, Chlamydia trachomatis
gagagcggccgctcgatcctgtagtacaaaataattcagc

SEQ ID NO: 327 - DNA, 33 bp, Chlamydia trachomatis
gagagcggccgcttaaaagattctattcaagcc

SEQ ID NO: 328 - DNA, 2148 bp, Chlymadia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcgatcctgtagtacaaaataattcagcagcgggtgcatcgacaccatcaccatcttcttcttctatgcctggtgctgtcacgattaatcagtccggtaatggatctgtgatttttaccgccgagtcattgactccttcagaaaaacttcaagttcttaactctacttctaacttcccaggagctctgactgtgtcaggaggggagttggttgtgacggaaggagctaccttaactactgggaccattacagccacctctggacgagtgactttaggatccggagcttcgttgtctgccgttgcaggtgctgcaaataataattatacttgtacagtatctaagttggggattgatttagaatcctttttaactcctaactataagacggccatactgggtgcggatggaacagttactgttaacagcggctctactttagacctagtgatggagaatgaggcagaggtctatgataatccgctttttgtgggatcgctgacaattccttttgttactctatcttctagtagtgctagtaacggagttacaaaaaattctgtcactattaatgatgcagacgctgcgcactatgggtatcaaggctcttggtctgcagattggacgaaaccgcctctggctcctgatgctaaggggatggtacctcctaataccaataacactctgtatctgacatggagacctgcttcgaattacggtgaatatcgactggatcctcagagaaagggagaactagtacccaactctctttgggtagcgggatctgcattaagaacctttactaatggtttgaaagaacactatgtttctagagatgttggatttgtagcatctctgcatgctctcggggattatattctgaattatacgcaagatgatcgggatggctttttagctagatatgggggattccaggcgaccgcagcctcccattatgaaaatgggtcaatatttggagtggcttttggacaactctatggtcagacaaagagcagaatgtattactctaaagatgctgggaacatgacgatgttgtcctgtttcggaagaagttacgtagatattaaaggaacagaaactgttatgtattgggagacggcttatggctattctgtgcacagaatgcatacgcagtattttaatgacaaaacgcagaagttcgatcattcgaaatgtcattggcacaacaataactattatgcgtttgtaggtgccgagcataatttcttagagtactgcattcctactcgtcagttagctagagattatgagcttacagggtttatgcgttttgaaatggccggaggatggtccagttctacacgagaaactggctccctaactagatatttcgctcgcgggtcagggcataatatgtcgcttccaataggaattgtagctcatgcagtttctcatgtgcgaagatctcctccttctaaactgacactaaatatgggatatagaccagacatttggcgtgtcactccacattgcaatatggaaattattgctaacggagtgaagacacctatacaaggatccccgctggcacggcatgccttcttcttagaagtgcatgatactttgtatattcatcattttggaagagcctatatgaactattcattagatgctcgtcgtcgacaaaccgcacattttgtatctatgggcttgaatagaatcttttaa

SEQ ID NO: 329 - protein, 715 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMENEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQLARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 330 - DNA, 38 bp, Chlymadia trachomatis
gagagcggccgctcatgaaatggctgtcagctactgcg

SEQ ID NO: 331 - DNA, 34 bp, Chlymadia trachomatis
gagcggccgcttacttaatgcgaatttcttcaag

SEQ ID NO: 332 - DNA, 1557 bp, Chlymadia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcatgaaatggctgtcagctactgcggtgtttgctgctgttctcccctcagtttcagggttttgcttcccagaacctaaagaattaaatttctctcgcgtagaaacttcttcctctaccacttttactgaaacaattggagaagctggggcagaatatatcgtctctggtaacgcatctttcacaaaatttaccaacattcctactaccgatacaacaactcccacgaactcaaactcctctagctctagcggagaaactgcttccgtttctgaggatagtgactctacaacaacgactcctgatcctaaaggtggcggcgccttttataacgcgcactccggagttttgtcctttatgacacgatcaggaacagaaggttccttaactctgtctgagataaaaatgactggtgaaggcggtgctatcttctctcaaggagagctgctatttacagatctgacaagtctaaccatccaaaataacttatcccagctatccggaggagcgatttttggaggatctacaatctccctatcagggattactaaagcgactttctcctgcaactctgcagaagttcctgctcctgttaagaaacctacagaacctaaagctcaaacagcaagcgaaacgtcgggttctagtagttctagcggaaatgattcggtgtcttcccccagttccagtagagctgaacccgcagcagctaatcttcaaagtcactttatttgtgctacagctactcctgctgctcaaaccgatacagaaacatcaactccctctcataagccaggatctgggggagctatctatgctaaaggcgaccttactatcgcagactctcaagaggtactattctcaataaataaagctactaaagatggaggagcgatctttgctgagaaagatgtttctttcgagaatattacatcattaaaagtacaaactaacggtgctgaagaaaagggaggagctatctatgctaaaggtgacctctcaattcaatcttctaaacagagtctttttaattctaactacagtaaacaaggtgggggggctctatatgttgaaggaggtataaacttccaagatcttgaagaaattcgcattaagtaa

SEQ ID NO: 333 - protein, 518 aa, Chlymadia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLMKWLSATAVFAAVLPSVSGFCFPEPKELNFSRVETSSSTTFTETIGEAGAEYIVSGNASFTKFTNIPTTDTTTPTNSNSSSSSGETASVSEDSDSTTTTPDPKGGGAFYNAHSGVLSFMTRSGTEGSLTLSEIKMTGEGGAIFSQGELLFTDLTSLTIQNNLSQLSGGAIFGGSTISLSGITKATFSCNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGGINFQDLEEIRIK

SEQ ID NO: 334 - DNA, 37 bp, Chlymadia trachomatis
gagagcggccgctcggtgacctctcaattcaatcttc

SEQ ID NO: 335 - DNA, 39 bp, Chlamydia trachomatis
gagagcggccgcttagttctctgttacagataaggagac

SEQ ID NO: 336 - DNA, 1758 bp, Chlymadia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcggtgacctctcaattcaatcttctaaacagagtctttttaattctaactacagtaaacaaggtgggggggctctatatgttgaaggaggtataaacttccaagatcttgaagaaattcgcattaagtacaataaagctggaacgttcgaaacaaaaaaaatcactttaccttctttaaaagctcaagcatctgcaggaaatgcagatgcttgggcctcttcctctcctcaatctggttctggagcaactacagtctccgactcaggagactctagctctggctcagactcggatacctcagaaacagttccagtcacagctaaaggcggtgggctttatactgataagaatctttcgattactaacatcacaggaattatcgaaattgcaaataacaaagcgacagatgttggaggtggtgcttacgtaaaaggaacccttacttgtgaaaactctcaccgtctacaatttttgaaaaactcttccgataaacaaggtggaggaatctacggagaagacaacatcaccctatctaatttgacagggaagactctattccaagagaatactgccaaagaagagggcggtggactcttcataaaaggtacagataaagctcttacaatgacaggactggatagtttctgtttaattaataacacatcagaaaaacatggtggtggagcctttgttaccaaagaaatctctcagacttacacctctgatgtggaaacaattccaggaatcacgcctgtacatggtgaaacagtcattactggcaataaatctacaggaggtaatggtggaggcgtgtgtacaaaacgtcttgccttatctaaccttcaaagcatttctatatccgggaattctgcagcagaaaatggtggtggagcccacacatgcccagatagcttcccaacggcggatactgcagaacagcccgcagcagcttctgccgcgacgtctactcccaaatctgccccggtctcaactgctctaagcacaccttcatcttctaccgtctcttcattaaccttactagcagcctcttcacaagcctctcctgcaacctctaataaggaaactcaagatcctaatgctgatacagacttattgatcgattatgtagttgatacgactatcagcaaaaacactgctaagaaaggcggtggaatctatgctaaaaaagccaagatgtcccgcatagaccaactgaatatctctgagaactccgctacagagataggtggaggtatctgctgtaaagaatctttagaactagatgctctagtctccttatctgtaacagagaactaa

SEQ ID NO: 337 - protein, 585 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLGDLSIQSSKQSLFNSNYSKQGGGALYVEGGINFQDLEEIRIKYNKAGTFETKKITLPSLKAQASAGNADAWASSSPQSGSGATTVSDSGDSSSGSDSDTSETVPVTAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTEN

SEQ ID NO: 338 - DNA, 38 bp, Chlamydai trachomatis
gagagcggccgctcgaccaactgaatatctctgagaac

SEQ ID NO: 339 - DNA, 35 bp, Chlamydia trachomatis
gagagcggccgcttaagagactacgtggagttctg

SEQ ID NO: 340 - DNA, 1965 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcgaccaactgaatatctctgagaactccgctacagagataggtggaggtatctgctgtaaagaatctttagaactagatgctctagtctccttatctgtaacagagaaccttgttgggaaagaaggtggaggcttacatgctaaaactgtaaatatttctaatctgaaatcaggcttctctttctcgaacaacaaagcaaactcctcatccacaggagtcgcaacaacagcttcagcacctgctgcagctgctgcttccctacaagcagccgcagcagccgcaccatcatctccagcaacaccaacttattcaggtgtagtaggaggagctatctatggagaaaaggttacattctctcaatgtagcgggacttgtcagttctctgggaaccaagctatcgataacaatccctcccaatcatcgttgaacgtacaaggaggagccatctatgccaaaacctctttgtctattggatcttccgatgctggaacctcctatattttctcggggaacagtgtctccactgggaaatctcaaacaacagggcaaatagcgggaggagcgatctactcccctactgttacattgaattgtcctgcgacattctctaacaatacagcctctatagctacaccgaagacttcttctgaagatggatcctcaggaaattctattaaagataccattggaggagccattgcagggacagccattaccctatctggagtctctcgattttcagggaatacggctgatttaggagctgcaataggaactctagctaatgcaaatacacccagtgcaactagcggatctcaaaatagcattacagaaaaaattactttagaaaacggttcttttatttttgaaagaaaccaagctaataaacgtggagcgatttactctcctagcgtttccattaaagggaataatattaccttcaatcaaaatacatccactcatgatggaagcgctatctactttacaaaagatgctacgattgagtctttaggatctgttctttttacaggaaataacgttacagctacacaagctagttctgcaacatctggacaaaatacaaatactgccaactatggggcagccatctttggagatccaggaaccactcaatcgtctcaaacagatgccattttaacccttcttgcttcttctggaaacattacttttagcaacaacagtttacagaataaccaaggtgatactcccgctagcaagttttgtagtattgcaggatacgtcaaactctctctacaagccgctaaagggaagactattagctttttcgattgtgtgcacacctctaccaaaaaaacaggttcaacacaaaacgtttatgaaactttagatattaataaagaagagaacagtaatccatatacaggaactattgtgttctcttctgaattacatgaaaacaaatcttacatcccacagaatgcaatccttcacaacggaactttagttcttaaagagaaaacagaactccacgtagtctcttaa

SEQ ID NO: 341 - protein, 654 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLDQLNISENSATEIGGGICCKESLELDALVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASIATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQNVYETLDINKEENSNPYTGTIVFSSELHENKSYIPQNAILHNGTLVLKEKTELHVVS

SEQ ID NO: 342 - DNA, 36 bp, Chlamydia trachomatis
gagagcggccgctcggaactattgtgttctcttctg

SEQ ID NO: 343 - DNA, 35 bp, Chlamydia trachomatis
gagagcggccgcttagaagatcatgcgagcaccgc

SEQ ID NO: 344 - DNA, 2103 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcggaactattgtgttctcttctgaattacatgaaaacaaatcttacatcccacagaatgcaatccttcacaacggaactttagttcttaaagagaaaacagaactccacgtagtctcttttgagcagaaagaagggtctaaattaattatggaacccggagctgtgttatctaaccaaaacatagctaacggagctctagctatcaatgggttaacgattgatctttccagtatggggactcctcaagcaggggaaatcttctctcctccagaattacgtatcgttgccacgacctctagtgcatccggaggaagcggggtcagcagtagtataccaacaaatcctaaaaggatttctgcagcagtgccttcaggttctgccgcaactactccaactatgagcgagaacaaagttttcctaacaggagaccttactttaatagatcctaatggaaacttttaccaaaaccctatgttaggaagcgatctagatgtaccactaattaagcttccgactaacacaagtgacgtccaagtctatgatttaactttatctggggatcttttccctcagaaagggtacatgggaacctggacattagattctaatccacaaacagggaaacttcaagccagatggacattcgatacctatcgtcgctgggtatacatacctagggataatcatttttatgcgaactctatcttaggctcccaaaactcaatgattgttgtgaagcaagggcttatcaacaacatgttgaataatgcccgcttcgatgatatcgcttacaataacttctgggtttcaggagtaggaactttcttagctcaacaaggaactcctctttccgaagaattcagttactacagccgcggaacttcagttgccatcgatgccaaacctagacaagattttatcctaggagctgcatttagtaagatagtggggaaaaccaaagccatcaaaaaaatgcataattacttccataagggctctgagtactcttaccaagcttctgtctatggaggtaaattcctgtatttcttgctcaataagcaacatggttgggcacttcctttcctaatacaaggagtcgtgtcctatggacatattaaacatgatacaacaacactttacccttctatccatgaaagaaataaaggagattgggaagatttaggatggttagcggatcttcgtatctctatggatcttaaagaaccttctaaagattcttctaaacggatcactgtctatggggaactcgagtattccagcattcgccagaaacagttcacagaaatcgattacgatccaagacacttcgatgattgtgcttacagaaatctgtcgcttcctgtgggatgcgctgtcgaaggagctatcatgaactgtaatattcttatgtataataagcttgcattagcctacatgccttctatctacagaaataatcctgtctgtaaatatcgggtattgtcttcgaatgaagctggtcaagttatctgcggagtgccaactagaacctctgctagagcagaatacagtactcaactatatcttggtcccttctggactctctacggaaactatactatcgatgtaggcatgtatacgctatcgcaaatgactagctgcggtgctcgcatgatcttctaa

SEQ ID NO: 345 - protein, 700 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAVPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKIVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 346 - DNA, 37 bp, Chlamydia trachomatis
gagagcggccgctcatgaaatttatgtcagctactgc

SEQ ID NO: 347 - DNA, 37 bp, Chlamydia trachomatis
gagagcggccgcttaccctgtaattccagtgatggtc

SEQ ID NO: 348 - DNA, 1464 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcatgaaatttatgtcagctactgctgtatttgctgcagtactctcctccgttactgaggcgagctcgatccaagatcaaataaagaataccgactgcaatgttagcaaagtaggatattcaacttctcaagcatttactgatatgatgctagcagacaacacagagtatcgagctgctgatagtgtttcattctatgacttttcgacatcttccggattacctagaaaacatcttagtagtagtagtgaagcttctccaacgacagaaggagtgtcttcatcttcatctggagaaaatactgagaattcacaagattcagctccctcttctggagaaactgataagaaaacagaagaagaactagacaatggcggaatcatttatgctagagagaaactaactatctcagaatctcaggactctctctctaatccaagcatagaactccatgacaatagttttttcttcggagaaggtgaagttatctttgatcacagagttgccctcaaaaacggaggagctatttatggagagaaagaggtagtctttgaaaacataaaatctctactagtagaagtaaatatctcggtcgagaaagggggtagcgtctatgcaaaagaacgagtatctttagaaaatgttaccgaagcaaccttctcctccaatggtggggaacaaggtggtggtggaatctattcagaacaagatatgttaatcagtgattgcaacaatgtacatttccaagggaatgctgcaggagcaacagcagtaaaacaatgtctggatgaagaaatgatcgtattgctcacagaatgcgttgatagcttatccgaagatacactggatagcactccagaaacggaacagactaagtcaaatggaaatcaagatggttcgtctgaaacaaaagatacacaagtatcagaatcaccagaatcaactcctagccccgacgatgttttaggtaaaggtggtggtatctatacagaaaaatctttgaccatcactggaattacagggtaa

SEQ ID NO: 349 - protein, 487 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLMKFMSATAVFAAVLSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNPSIELHDNSFFFGEGEVIFDHRVALKNGGAIYGEKEVVFENIKSLLVEVNISVEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETKDTQVSESPESTPSPDDVLGKGGGIYTEKSLTITGITG

SEQ ID NO: 350 - DNA, 37 bp, Chlamydia trachomatis
gagagcggccgctcgatacacaagtatcagaatcacc

SEQ ID NO: 351 - DNA, 37 bp, Chlamydia trachomatis
gagagcggccgcttaagaggacgatgagacactctcg

SEQ ID NO: 352 - DNA, 1752 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcgatacacaagtatcagaatcaccagaatcaactcctagccccgacgatgttttaggtaaaggtggtggtatctatacagaaaaatctttgaccatcactggaattacagggactatagattttgtcagtaacatagctaccgattctggagcaggtgtattcactaaagaaaacttgtcttgcaccaacacgaatagcctacagtttttgaaaaactcggcaggtcaacatggaggaggagcctacgttactcaaaccatgtctgttactaatacaactagtgaaagtataactactccccctctcgtaggagaagtgattttctctgaaaatacagctaaagggcacggtggtggtatctgcactaacaaactttctttatctaatttaaaaacggtgactctcactaaaaactctgcaaaggagtctggaggagctatttttacagatctagcgtctataccaacaacagataccccagagtcttctaccccctcttcctcctcgcctgcaagcactcccgaagtagttgcttctgctaaaataaatcgattctttgcctctacggcagaaccggcagccccttctctaacagaggctgagtctgatcaaacggatcaaacagaaacttctgatactaatagcgatatagacgtgtcgattgagaacattttgaatgtcgctatcaatcaaaacacttctgcgaaaaaaggaggggctatttacgggaaaaaagctaaactttcccgtattaacaatcttgaactttcagggaattcatcccaggatgtaggaggaggtctctgtttaactgaaagcgtagaatttgatgcaattggatcgctcttatcccactataactctgctgctaaagaaggtggggttattcattctaaaacggttactctatctaacctcaagtctaccttcacttttgcagataacactgttaaagcaatagtagaaagcactcctgaagctccagaagagattcctccagtagaaggagaagagtctacagcaacagaaaatccgaattctaatacagaaggaagttcggctaacactaaccttgaaggatctcaaggggatactgctgatacagggactggtgttgttaacaatgagtctcaagacacatcagatactggaaacgctgaatctggagaacaactacaagattctacacaatctaatgaagaaaatacccttcccaatagtagtattgatcaatctaacgaaaacacagacgaatcatctgatagccacactgaggaaataactgacgagagtgtctcatcgtcctcttaa

SEQ ID NO: 353 - protein, 583 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSS

SEQ ID NO: 354 - DNA, 39 bp, Chlamydia trachomatis
gagagcggccgctcgatcaatctaacgaaaacacagacg

SEQ ID NO: 355 - DNA, 36 bp, Chlamydia trachomatis
gagagcggccgcttagaccaaagctccatcagcaac

SEQ ID NO: 356 - DNA, 2052 bp, Chlamydia trachomatis
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattctgcagatatccatcacactggcggccgctcgatcaatctaacgaaaacacagacgaatcatctgatagccacactgaggaaataactgacgagagtgtctcatcgtcctctaaaagtggatcatctactcctcaagatggaggagcagcttcttcaggggctccctcaggagatcaatctatctctgcaaacgcttgtttagctaaaagctatgctgcgagtactgatagctcccctgtatctaattcttcaggttcagacgttactgcatcttctgataatccagactcttcctcatctggagatagcgctggagactctgaaggaccgactgagccagaagctggttctacaacagaaactcctactttaataggaggaggwgctatctatggagaaactgttaagattgagaacttctctggccaaggaatattttctggaaacaaagctatcgataacaccacagaaggctcctcttccaaatctaacgtcctcggaggtgcggtctatgctaaaacattgtttaatctcgatagcgggagctctagacgaactgtcaccttctccgggaatactgtctcttctcaatctacaacaggtcaggttgctggaggagctatctactctcctactgtaaccattgctactcctgtagtattttctaaaaactctgcaacaaacaatgctaataacgctacagatactcagagaaaagacacctttggaggagctatcggagctacttctgctgtttctctatcaggaggggctcatttcttagaaaacgttgctgacctcggatctgctattgggttggtgccagacacacaaaatacagaaacagtgaaattagagtctggctcctactactttgaaaaaaataaagctttaaaacgagctactatttacgcacctgtcgtttccattaaagcctatactgcgacatttaaccaaaacagatctctagaagaaggaagcgcgatttactttacaaaagaagcatctattgagtctttaggctctgttctcttcacaggaaacttagtaaccccaacgctaagcacaactacagaaggcacaccagccacaacctcaggagatgtaacaaaatatggtgctgctatctttggacaaatagcaagctcaaacggatctcagacggataaccttcccctgaaactcattgcttcaggaggaaatatttgtttccgaaacaatgaataccgtcctacttcttctgataccggaacctctactttctgtagtattgcgggagatgttaaattaaccatgcaagctgcaaaagggaaaacgatcagtttctttgatgcaatccggacctctactaagaaaacaggtacacaggcaactgcctacgatactctcgatattaataaatctgaggattcagaaactgtaaactctgcgtttacaggaacgattctgttctcctctgaattacatgaaaataaatcctatattccacaaaacgtagttctacacagtggatctcttgtattgaagccaaataccgagcttcatgtcatttcttttgagcagaaagaaggctcttctctcgttatgacacctggatctgttctttcgaaccagactgttgctgatggagctttggtctaa

SEQ ID NO: 357 - protein, 683 aa, Chlamydia trachomatis
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFCRYPSHWRPLDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSNVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALV

SEQ ID NO: 358 - DNA, 1248 bp, Chlamydia
catatgcatcaccatcaccatcaccctccagaatcgggcttaatcatagccattcacgatgatcctcgctctctttctccagaaaaaggagaaaatgctttccatttttctttgtccaaggctttatttgctactctcttcagagaagagctctctggattaacccctgctctggtctcctcctatcaagtttcggaagacgggcggttttatcgtttttgtattcgtaaagatgctaagtggagtgacggctctcttttacttgcagaagatgtaatagctgcttgggaacacactaaacaagctgggcgatattccctactttttgaaaagctatcttttcgagcctcttcttcttcggaaatccttattgaactcaaagaacccgagcctcaactattggcgatattagcctctccgttttttgctgtgtatcgtccagaaaatccttttctttcttctggaccttttatgccaaaaacctatgtgcaagggcaaacgctcgttctacaaaaaaacccttattactatgaccatgcgcatgtggaattacattccatagactttcgcatcattcccaacatttacacagctctacacctcttaagaagaggtgacgtggattgggtggggcagccttggcaccaagggattccttttgagcttcggactacctctgctctctacacccattaccctgtagatggcacattctggcttattcttaatcccaaagatcctgtactttcctctctatctaatcgtcagcgattgattgctgccatccaaaaggaaaaactggtgaagcaagctttaggaacacaatatcgagtagctgaaagctctccatctccagagggaatcatagctcatcaagaagcttctactccttttcctgggaaaattactttgatatatcccaataatattacgcgctgtcagcgtttggccgaggtattgcaagaacaatgccgagacgcaggtatccagctgactcttgaaggactcgaataccatgtatttgttcaaaaacgagccactcaagatttctctgtctccacagcaacttctatagctttccatccccttgctaaatctaagttcgatcaaacggctctagacaatttcacttgtctgcccttgtaccacatagaatatgattatattttgagcagaccgctagatcaaattgttcactatccttcaggtagtgttgatttgacctatgcacactttcactaggaattc

SEQ ID NO: 359 - DNA, 1311 bp, Chlamydia
catatgcatcaccatcaccatcacatgtatgttcgctctatcttttttagtattatcgccttcctaacggtcggatgctccttttctcctccagaatcgggcttaatcatagccattcacgatgatcctcgctctctttctccagaaaaaggagaaaatgctttccatttttctttgtccaaggctttatttgctactctcttcagagaagagctctctggattaacccctgctctggtctcctcctatcaagtttcggaagacgggcggttttatcgtttttgtattcgtaaagatgctaagtggagtgacggctctcttttacttgcagaagatgtaatagctgcttgggaacacactaaacaagctgggcgatattccctactttttgaaaagctatcttttcgagcctcttcttcttcggaaatccttattgaactcaaagaacccgagcctcaactattggcgatattagcctctccgttttttgctgtgtatcgtccagaaaatccttttctttcttctggaccttttatgccaaaaacctatgtgcaagggcaaacgctcgttctacaaaaaaacccttattactatgaccatgcgcatgtggaattacattccatagactttcgcatcattcccaacatttacacagctctacacctcttaagaagaggtgacgtggattgggtggggcagccttggcaccaagggattccttttgagcttcggactacctctgctctctacacccattaccctgtagatggcacattctggcttattcttaatcccaaagatcctgtactttcctctctatctaatcgtcagcgattgattgctgccatccaaaaggaaaaactggtgaagcaagctttaggaacacaatatcgagtagctgaaagctctccatctccagagggaatcatagctcatcaagaagcttctactccttttcctgggaaaattactttgatatatcccaataatattacgcgctgtcagcgtttggccgaggtattgcaagaacaatgccgagacgcaggtatccagctgactcttgaaggactcgaataccatgtatttgttcaaaaacgagccactcaagatttctctgtctccacagcaacttctatagctttccatccccttgctaaatctaagttcgatcaaacggctctagacaatttcacttgtctgcccttgtaccacatagaatatgattatattttgagcagaccgctagatcaaattgttcactatccttcaggtagtgttgatttgacctatgcacactttcactaggaattc

SEQ ID NO: 360 - DNA, 813 bp, Chlamydia
atgcatcaccatcaccatcacggaaattctggtttttatttgtataacactcaaaactgcgtctttgctgataatatcaaagttgggcaaatgacagagccgctcaaggaccagcaaataatccttgggacaacatcaacacctgtcgcagccaaaatgacagcttctgatggaatatctttaacagtctccaataatccatcaaccaatgcttctattacaattggtttggatgcggaaaaagcttaccagcttattctagaaaagttgggagatcaaattcttggtggaattgctgatactattgttgatagtacagtccaagatattttagacaaaatcacaacagacccttctctaggtttgttgaaagcttttaacaactttccaatcactaataaaattcaatgcaacgggttattcactcccaggaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctacgcgattagttatggatactcatcaggcgttcctaatttatgtagtctaagaaccagaattattaatacaggattgactccgacaacgtattcattacgtgtaggcggtttagaaagcggtgtggtatgggttaatgccctttctaatggcaatgatattttaggaataacaaatacttctaatgtatcttttttggaggtaatacctcaaacaaacgcttaa

SEQ ID NO: 361 - DNA, 750 bp, Chlamydia
atgcatcaccatcaccatcacaaaataactccgatcaaaacacgtaaagtatttgcacatgattcgcttcaagagatcttgcaagaggctttgccgcctctgcaagaacggagtgtggtagttgtctcttcaaagattgtgagtttatgtgaaggcgctgtcgctgatgcaagaatgtgcaaagcagagttgataaaaaaagaagcggatgcttatttgttttgtgagaaaagcgggatatatctaacgaaaaaagaaggtattttgattccttctgcagggattgatgaatcgaatacggaccagccttttgttttatatcctaaagatattttgggatcgtgtaatcgcatcggagaatggttaagaaattattttcgagtgaaagagctaggcgtaatcattacagatagccatactactccaatgcggcgtggagtactgggtatcgggctgtgttggtatggattttctccattacacaactatataggatcgctagattgtttcggtcgtcccttacagatgacgcaaagtaatcttgtagatgccttagcagttgcggctgttgtttgtatgggagaggggaatgagcaaacaccgttagcggtgatagagcaggcacctaatatggtctaccattcatatcctacttctcgagaagagtattgttctttgcgcatagatgaaacagaggacttatacggaccttttttgcaagcggttacgtggagtcaagaaaagaaatag

SEQ ID NO: 362 - protein, 412 aa, Chlamydia
MHHHHHHPPESGLIIAIHDDPRSLSPEKGENAFHFSLSKALFATLFREELSGLTPALVSSYQVSEDGRFYRFCIRKDAKWSDGSLLLAEDVIAAWEHTKQAGRYSLLFEKLSFRASSSSEILIELKEPEPQLLAILASPFFAVYRPENPFLSSGPFMPKTYVQGQTLVLQKNPYYYDHAHVELHSIDFRIIPNIYTALHLLRRGDVDWVGQPWHQGIPFELRTTSALYTHYPVDGTFWLILNPKDPVLSSLSNRQRLIAAIQKEKLVKQALGTQYRVAESSPSPEGIIAHQEASTPFPGKITLIYPNNITRCQRLAEVLQEQCRDAGIQLTLEGLEYHVFVQKRATQDFSVSTATSIAFHPLAKSKFDQTALDNFTCLPLYHIEYDYILSRPLDQIVHYPSGSVDLTYAHFH

SEQ ID NO: 363 - protein, 433 aa, Chlamydia
MHHHHHHMYVRSIFFSIIAFLTVGCSFSPPESGLIIAIHDDPRSLSPEKGENAFHFSLSKALFATLFREELSGLTPALVSSYQVSEDGRFYRFCIRKDAKWSDGSLLLAEDVIAAWEHTKQAGRYSLLFEKLSFRASSSSEILIELKEPEPQLLAILASPFFAVYRPENPFLSSGPFMPKTYVQGQTLVLQKNPYYYDHAHVELHSIDFRIIPNIYTALHLLRRGDVDWVGQPWHQGIPFELRTTSALYTHYPVDGTFWLILNPKDPVLSSLSNRQRLIAAIQKEKLVKQALGTQYRVAESSPSPEGIIAHQEASTPFPGKITLIYPNNITRCQRLAEVLQEQCRDAGIQLTLEGLEYHVFVQKRATQDFSVSTATSIAFHPLAKSKFDQTALDNFTCLPLYHIEYDYILSRPLDQIVHYPSGSVDLTYAHFH

SEQ ID NO: 364 - protein, 264 aa, Chlamydia
MGNSGFYLYNTQNCVFADNIKVGQMTEPLKDQQIILGTTSTPVAAKMTASDGISLTVSNNPSTNASITIGLDAEKAYQLILEKLGDQILGGIADTIVDSTVQDILDKITTDPSLGLLKAFNNFPITNKIQCNGLFTPRNIETLLGGTEIGKFTVTPKSSGSMFLVSADIIASRMEGGVVLALVREGDSKPYAISYGYSSGVPNLCSLRTRIINTGLTPTTYSLRVGGLESGVVWVNALSNGNDILGITNTSNVSFLEVIPQTNA

SEQ ID NO: 365 - protein, 249 aa, Chlamydia
MHHHHHHKITPIKTRKVFAHDSLQEILQEALPPLQERSVVVVSSKIVSLCEGAVADARMCKAELIKKEADAYLFCEKSGIYLTKKEGILIPSAGIDESNTDQPFVLYPKDILGSCNRIGEWLRNYFRVKELGVIITDSHTTPMRRGVLGIGLCWYGFSPLHNYIGSLDCFGRPLQMTQSNLVDALAVAAVVCMGEGNEQTPLAVIEQAPNMVYHSYPTSREEYCSLRIDETEDLYGPFLQAVTWSQEKK

SEQ ID NO: 366 - DNA, 2418 bp, Chlamydia pneumoniae
atggacccaaaagaaaaaaattacgatgcatccgctattactgttttagaagggctacaagctgttcgtgagcgccccgggatgtacattggagatacgggaatcacgggtcttcatcatctagtctatgaggttgtagacaacagcattgacgaagccatggcaggttattgctctaggattgatgttcgcattttagaggacgggggtattgtcatcgtagataatggccgaggaatccctatagaagttcacgaaagagagtctgcaaaacaaggtagagaggtctctgctttagaagtggttttaacagtccttcatgctggaggaaaattcgataaggatagctataaagtatccggaggcttgcacggagttggggtttcttgcgttaatgctctttcggagaaattagttgccacggtctttaaagataagaagtgttatcaaatggagttctctaggggaattcctgtaactccattgcagtatgtaagtgttagtgatcggcagggaacagaaatcgttttctaccctgatcctaaaatattttcgacttgtacttttgatcgctctattttaatgaaacgcttgcgagagcttgctttcttaaatcgtgggatcacaatagtctttgaagatgatcgagatgttagctttgacaaggttaccttcttttatgagggagggattcaatcttttgtaagttacctgaatcaaaataaagaaagccttttctctgaaccgatttatatttgtggaactcgagtaggagatgatggagaaatcgagtttgaagcagccttacaatggaattcagggtattctgaacttgtttattcctatgccaataatattcctacacgccaaggaggaacgcatcttacagggttttctaccgcgcttactagggtaatcaatacgtatattaaagctcataaccttgcgaagaataataagcttgcattaaccggagaagatattcgagaaggtctgacagctgtgatttctgtaaaggtcccaaatccacaatttgaagggcaaacaaaacagaaattaggaaacagtgatgttagctcagtggctcaacaggttgtaggggaagctctgacaatcttttttgaagagaatcctcaaattgctaggatgattgttgataaggtttttgttgcagcgcaagctagagaagctgcaaaaaaagctcgagaattgactttaaggaaaagtgctttagatagcgcacgcttacctggaaaactaattgattgtttagaaaaagatcccgaaaagtgtgagatgtacattgtggagggggattctgctggaggatctgcgaaacaaggtagagatcgaagatttcaagcaattctgcctattcgaggtaaaattctgaacgtagaaaaagctcgtctacagaaaattttccaaaaccaagagataggaaccatcatagcagctttaggctgtggcataggtgctgataattttaatctcagtaaattacgctatagacgtatcattatcatgacagatgctgacgtggacggttctcatattcgtaccctacttctcacattcttctatcgtcatatgacagcgcttattgaaaatgaatgtgtttatattgctcaacctcctttatacaaggtgagtaagaaaaaagacttccgttatattctttcagagaaagaaatggacagctatttgctcatgttaggcacgaatgagagctccattctctttaaatctacggaaagagaattacgtggagaggctttagagagttttatcaacgtcattttagatgtagagagctttataaacactcttgagaaaaaagcgattcccttctctgaatttttagagatgtataaagaggggataggctatcctttgtactatcttgctccggcaactggaatgcagggagggcgctatctttattctgatgaggaaaaagaagaagctttagctcaagaagaaactcataagtttaaaatcatagagctttataaagttgctgtgttcgtagatattcaaaatcaactcaaagaatatggtttagatatttctagctatcttatccctcagaaaaacgagattgtgattggaaatgaagattccccaagctgtaactatagctgctataccttggaagaagtcattaactatcttaaaaatcttggaagaaaaggcatagaaattcagaggtataaaggtcttggagagatgaatgccgaccagctttgggatactactatgaatcctgagcagagaacactcattcatgtgtcattgaaggatgccgtagaagcagaccatattttcactatgttgatgggggaagaagtccctccaagaagagaattcatagaaagtcatgctttgtccattaggataaataatttagatatttag

SEQ ID NO: 367 - DNA, 888 bp, Chlamydia pneumoniae
atggaaaagttactagtgactgatattgacggtacaattacccatcaatctcatcatttagataaaaaggtgtatgagcggctctatgcgctgcaccaagctggttggaagttgtttttcttgacgggaaggtattataaatatgctgcacgcttgttttctgattttgatgctccatatttattaggatgccaaaacggcgcttctgtatggtcttcaacatcatcaaatcttctctattctaaaagtttaccctcagatttattatgtattttacaagattgtatggagggggcaacggctcttttttccgtggaatcaggagctccttacggggatcactactatcgcttttcaccgactcctatagctcaagatttacacgaatatgtagatcctaggtactttcctaatgctaaggaaagagagatcctatttgaaacgcgctctttaaaagacgactatgcttttcctagttttgctgcagcaaaagtctttggactgcgagatgaggtcatcagaattcaaaaggagctggaacgccaagaagcactgacttcagtcgcgacgatgacgttaatgcgctggccctttgactttcgctatgccatcttgtttttaacagataaaagcgtctctaaaggcaaagccttagatcgtgttgtcaatatactttatgatggaaagaaaccctttgtcatggcttcaggagatgatgctaatgatctcgatcttattgagagaggagattttaaaattgtgatgagttccgcacctgaagagatgcacgttcatgcggactttctagctcccccagcagataagaatggcattctttcagcttgggaagctggtgtccgctattatgacgaccttatgagtctttag

SEQ ID NO: 368 - DNA, 237 bp, Chlamydia pneumoniae
atgaaagaatttttagcctatatcattaagaatctagtggaccgccctgaagaagtccgtattaaagaagttcaggggactcacacgattatttatgaactaagtgtagctaaacctgatatcgggaagatcattggcaaagaaggccgtacgatcaaagcgattcgtactcttctggtttctgtagcaagcaggaacaatgtaagggtcagtttagaaattatggaagaaaagtag

SEQ ID NO: 369 - DNA, 1437 bp, Chlamydia pneumoniae
atgcgtgacgtttcagagctttttcgaacacattttatgcattacgcgtcttacgtaattttagagagagcgattcctcatattcttgatggcttaaaaccggtgcagcgtcgacttctatggactttattccttatggacgacgggaaaatgcataaagttgccaatattgcaggaagaactatggctctccatccccatggcgatgcccctattgttgaagctcttgttgtcttagcaaataaaggctacctcatcgacacgcaaggaaacttcggaaatccccttacgggagatcctcacgctgctgcccgttatatagaagcacgactcagtcctttagctcgagaaacgctctttaataccgacttgatagcttttcatgactcttatgatggaagagaaaaagaacctgatattttacctgcaaagctccccgtgcttttacttcatggtgtggacgggattgctgtggggatgaccacgaaaattttccctcacaattttgcagaacttttgaaagcgcaaattgcaattttaaatgataaaaaattcactgtgtttcctgactttccttcgggaggattgatggatccctcggagtatcaagatggattgggatcgattacactgcgtgcatctatagacattattaatgataaaacgcttgtagtgaaacaaatttgtcctcaatctacgactgagactttgatccgttctatagagaacgcagcaaaacgtggcacaattaaaatcgataccatccaagacttctctacagatgtccctcacattgaaattaagctgccaaaaggctctcgagccaaagagatgcttcccttgttattcgagcatactgaatgccaggtgattctctattctaagcccacagtcatttacgagaataagcctgtagaatgttcgatatccgagattctcaaactgcatactacagctctacaggggtatcttgaaaaagaacttttgttgctccaagaacaacttactttggaccattatcataaaaccttagaatacatctttattaaacataagctctatgattctgtccgagaagtcctagccataaacaagaaaatttctgctgatgacctacatcaagcagtgctccatgctctggagccctggcttcatgagcttgcaactcccgttacaaaacaagacacctctcaacttgcttcactaacgattaagaaaatcctttgctttaatgaagaggcatgcactaaggaactgctagccatagaaaaaaaacaagcagcgatacaaaaagatcttggaagaataaaagaagtcaccgtcaagtacctcaaaggacttttagaacgccatggacacttaggagagagaaaaacacagatcacaaactttaagacggcaaagacatctatcttgaaacaacaaaccttaatttaa

SEQ ID NO: 370 - DNA, 774 bp, Chlamydia pneumoniae
atggcattttattctccttcaacgatctctaaatattttatctattctggagcaggaaatcgtttccttcttggtgaaacacttcctgaggttgaagatgttcggttcttatgccaagagacgagggttgatggttttttatatttaaagccctcttcttgtgctgatgcgcaactcattatttttaattccgatggatcacgtccaacgatgtgtggtaacggcttgcgttgtgcgattgctcacttagcttctcagaagggaaaatcggacatctctgtatctacggatagtggtctatattcaggatatttttattcttgggatcgtgtgcttgtagatatgactctcgcagattggagagcttctgttcatcgattggagtcgcgtcctgatcctcttcccaaagaggtcgtttgtatccatacgggagtgcctcatgctgtcgtaattcttcctgagatttctactttagatctttctatcttaggtccttttcttcgctatcatcagaccttctctccagatggggtgaatgtcaattttgttcagatactgggacattgccagttgcgcgttcgtacttacgaacgtggagtcgaaggggaaactgcagcttgtggaacaggggctctagcttctgctcttgttgtgtcaaactcctatggatggaaggagtcgatccaaatccatacttggggtggagagcttatgactgtgagtcaaaataggggacgggtatatcttcagggctctgtaactagagatttataa

SEQ ID NO: 371 - DNA, 576 bp, Chlamydia pneumoniae
atggcagacggggaagttcataaattacgtgatattatagaaaaagagttattggaagcgcgcagagtatttttctcagagcctgtaacagagaaaagtgcttccgatgcaattaaaaagctttggtatttggaattaaaagatcctggaaagcctatagtttttgtgatcaatagtcctgggggatctgtggacgcaggttttgctgtttgggatcaaattaaaatgttaacctcacccgtcactactgttgtgacagggttggcagcttctatgggctcggtattgagtttatgtgcagctcctggaaggagatttgcaactcctcattctagaattatgattcatcaaccttcaataggtggaccgattaccggtcaggcaaccgatttagacattcatgcgagagagattttaaaaacaaaagctcgcattatagatgtctatgtagaggcgacaaatcaacctcgagatatcatagaaaaggctatcgatagagatatgtggatgacagccaacgaagctaaggattttggtttattggatggcattttattctccttcaacgatctctaa

SEQ ID NO: 372 - DNA, 699 bp, Chlamydia pneumoniae
atgacaaaacatggaaaacgtatacgaggcatcttaaagaactatgatttctcaaaatcatattctttgcgggaggctatagatattttaaaacaatgtcctccagtacgcttcgatcaaactgtagatgtatctatcaagttagggatagatcctaaaaagagcgaccaacaaattcgtggagccgtttttttacctaatggtacaggaaaaactttaagaattttggtttttgcttcagggaacaaagtcaaagaagctgttgaagcgggcgcagactttatgggaagcgacgatcttgttgaaaaaattaaatccgggtggctggaattcgatgttgctgtcgctaccccagatatgatgcgtgaagtaggaaaattaggaaaagtcttaggacctagaaatctaatgcctacacctaaaacaggaacggtaaccacagacgttgctaaagcaatctccgaattgcgtaaaggaaaaattgaatttaaagcagaccgcgcaggcgtatgtaatgtaggcgtaggtaagttgtcttttgaaagcagtcaaatcaaagaaaatattgaagctctaagttctgctttaattaaggccaaacctcctgcagctaaaggtcaatatttagtctcattcactatttcttccactatggggcctggtatttctatagatactagagaattaatggcatcttaa

SEQ ID NO: 373 - DNA, 369 bp, Chlamydia pneumoniae; identical to SEQ ID NO: 29

SEQ ID NO: 374 - DNA, 5172 bp, Chlamydia pneumoniae
atgaagtggctaccagctacagctgtttttgctgccgtactccccgcactaacagccttcggagatcccgcgtctgttgaaataagtaccagccatacaggatccggggatcctacaagcgacgctgccttaacaggatttacacaaagttccacagaaactgacggtactacctataccattgtcggtgatatcaccttctctacttttacgaatattcctgttcccgtagtaactccagacgccaacgatagttccagcaatagctctaaaggaggaagtagcagtagtggagctacatctctaatccgatcctcaaacctacactccgattttgattttacaaaagatagcgtgttagacctctatcaccttttctttccttcagcttcaaatactctcaatcctgcactcctttcttccagtagcagcggtggatcctcgagcagcagtagctcctcatcatctggaagtgcatctgctgttgttgctgcggacccaaaaggaggcgctgccttttatagtaacgaggctaacggaactttaaccttcactacagactctggaaatcccggctccctgactcttcagaatcttaaaatgaccggagatggagccgccatctactcgaagggtcctctagtatttactggtttaaaaaatctaacctttacaggaaatgaatctcagaaatctggaggtgctgcctatactgaaggcgcactcacaacacaagcaatcgttgaagccgtaacttttactggcaacacctcggcagggcaaggaggcgctatctatgttaaagaagctaccctattcaatgctctagacagcctcaaatttgaaaaaaacacttctgggcaagctggtggtggaatctatacagagtctacgctcacaatctcgaacatcacaaaatctattgaatttatctctaataaagcttctgtccctgcccccgctcctgagcccacctctccggctccaagtagcttaataaattctacaacgatcgatacctcgactctccaaacccgagcagcatccgcaactccagcagtggctcctgttgctgccgtaactccaacaccaatctctactcaagagaccgcaggaaatggaggcgctatctatgctaaacaaggtatttcgatatccacgtttaaagatctgaccttcaagtctaactctgcatcggtagatgccacccttactgtcgattctagcactattggagaatctggaggtgctatctttgcagcagactctatacaaatccaacagtgcacgggaaccaccttattcagtggcaatactgccaataagtctggtgggggtatttacgctgtaggacaagtcaccctagaagatatagcgaatctgaagatgaccaacaacacctgtaaaggtgaaggtggagccatctacactaaaaaggctttaactatcaacaacggtgccattctcactacattttctggaaatacatcgacagataatggtggggctatttttgctgtaggtggcatcactctctctgatcttgtagaagtccgctttagtaaaaataagaccggaaattattccgctcctattaccaaagcggctagcaacacagctcctgtagtttctagctctacaactgctgcatctcctgcggtccctgctgccgctgcagcacctgttacaaacgcagcaaaaggaggggctttatatagtacagaaggactgactgtatctggaatcacatcgatattgtcgtttgaaaacaacgaatgccagaatcaaggaggtggggcttacgttactaaaaccttccagtgttccgattctcatcgcctccagtttactagtaataaagcagcagatgaaggcgggggcctgtattgtggtgacgatgtcacgctaacgaacctgacagggaaaacactatttcaagagaatagcagtgagaaacatggaggtgggctctctctcgcctcaggaaaatctctgactatgacatcgttagagagcttctgcttaaatgcaaatacagcaaaggaaaacggaggcggtgcgaatgtccctgaaaatattgtactcaccttcacctatactcccactccaaatgaacctgcgcctgtgcagcagcccgtgtatggagaagctcttgttactggaaatacagccacaaaaagtggtgggggcatttacacgaaaaatgcggccttctcaaatttatcttctgtaacttttgatcaaaatacctcttcagaaaatggtggtgccttacttacccaaaaagctgcagataaaacggactgttctttcacctatattacaaatgtcaatatcaccaacaatacagctacaggaaatggtgggggcattgctgggggaaaagcacatttcgatcgcattgataatcttacagtccaaagcaaccaagcaaagaaaggtggtggggtttatcttgaagatgccctcatcctggaaaaggttattacaggttctgtctcacaaaatacagctacagaaagtggtgggggtatctacgctaaggatattcaactacaagctctacctggaagcttcacaattaccgataataaagtcgaaactagtcttactactagcactaatttatatggtgggggcatctattccagtggagctgtcacgctaaccaatatatctggaacctttggcattacaggaaactctgttatcaatacagcgacatcccaggatgcagatatacaaggtgggggcatttatgcaaccacgtctctctcaataaatcaatgtaatacacccattctatttagcaacaactctgctgccactaaaaaaacatcaacaacaaagcaaattgctggtggggctatcttctccgctgcagtaactatcgagaataactctcagcccattattttcttaaataattccgcaaagtcggaagcaactacagcagcaactgcaggaaataaagatagctgtggaggagccattgcagctaactctgttactttaacaaataaccctgaaataacctttaaaggaaattatgcagaaactggaggagcgattggctgtattgatcttactaatggctcacctccccgtaaagtctctattgcagacaacggttctgtcctttttcaagacaactctgcgttaaatcgcggaggcgctatctatggagagactatcgatatctccaggacaggtgcgactttcatcggtaactcttcaaaacatgatggaagtgcaatttgctgttcaacagccctaactcttgcgccaaactcccaacttatctttgaaaacaataaggttacggaaaccacagccactacaaaagcttccataaataatttaggagctgcaatttatggaaataatgagactagtgacgtcactatctctttatcagctgagaatggaagtattttctttaaaaacaatctatgcacagcaacaaacaaatactgcagtattgctggaaacgtaaaatttacagcaatagaagcttcagcagggaaagctatatctttctatgatgcagttaacgtttccaccaaagaaacaaatgctcaagagctaaaattaaatgaaaaagcgacaagtacaggaacgattctattttctggggaacttcacgaaaataaatcctatattccacagaaagtcactttcgcacatgggaatctcattctaggtaaaaatgcagaacttagcgtagtttcctttacccaatctccaggcaccacaatcactatgggcccaggatcggttctttccaaccatagcaaagaagcaggaggaatcgctataaacaatgtcatcattgattttagtgaaatcgttcctactaaagataatgcaacagtagctccacccactcttaaattagtatcgagaactaatgcagatagtaaagataagattgatattacaggaactgtgactcttctagatcctaatggcaacttatatcaaaattcttatcttggtgaagaccgcgatatcactcttttcaatatagacaattctgcaagtggggcagttacagccacgaatgtcacccttcaagggaatttaggagctaaaaaaggatatttaggaacctggaatttggatccaaattcctcgggttcaaaaattattctaaaatggacctttgacaaatacctgcgctggccctacatccctagagacaaccacttctacatcaactctatttggggagcacaaaactctttagtgactgtgaaacaagggatcttagggaacatgttgaacaatgcaaggtttgaagatcctgctttcaacaacttctgggcttcggctataggatctttccttaggaaagaagtatctcgaaattctgactcattcacctatcatggcagaggctataccgctgctgtggatgccaaacctcgccaagaatttattttaggagctgccttcagtcaggtttttggtcacgccgagtctgaatatcaccttgacaactataagcataaaggctcaggtcactctacacaagcatctctttatgctggcaatatcttctattttcctgcgatacggtctcggcctattctattccaaggtgtggcgacctatggttatatgcaacatgacaccacaacctactatccttctattgaagaaaaaaatatggcaaactgggatagcattgcttggttatttgatctgcgtttcagtgtggatcttaaagaacctcaacctcactctacagcaaggcttaccttctatacagaagctgagtataccagaattcgccaggagaaattcacagagctagactatgatcctagatctttctctgcatgctcttatggaaacttagcaattcctactggattctctgtagacggagcattagcttggcgtgagattattctatataataaagtatcagctgcgtacctccctgtgattctcaggaataatccaaaagcgacctatgaagttctctctacaaaagaaaagggcaacgtagtcaacgttctccctacaagaaacgcagctcgtgcagaggtgagctctcaaatttatcttggaagttactggacactctacggcacgtatactattgatgcttcaatgaatactttagtgcaaatggccaacggagggatccggtttgtattctag

SEQ ID NO: 375 - DNA, 5172 bp, Chlamydia pneumoniae
atgaagtggctaccagctacagctgtttttgctgccgtactccccgcactaacagccttcggagatcccgcgtctgttgaaataagtaccagccatacaggatccggggatcctacaagcgacgctgccttaacaggatttacacaaagttccacagaaactgacggtactacctataccattgtcggtgatatcaccttctctacttttacgaatattcctgttcccgtagtaactccagacgccaacgatagttccagcaatagctctaaaggaggaagtagcagtagtggagctacatctctaatccgatcctcaaacctacactccgattttgattttacaaaagatagcgtgttagacctctatcaccttttctttccttcagcttcaaatactctcaatcctgcactcctttcttccagtagcagcggtggatcctcgagcagcagtagctcctcatcatctggaagtgcatctgctgttgttgctgcggacccaaaaggaggcgctgccttttatagtaacgaggctaacggaactttaaccttcactacagactctggaaatcccggctccctgactcttcagaatcttaaaatgaccggagatggagccgccatctactcgaagggtcctctagtatttactggtttaaaaaatctaacctttacaggaaatgaatctcagaaatctggaggtgctgcctatactgaaggcgcactcacaacacaagcaatcgttgaagccgtaacttttactggcaacacctcggcagggcaaggaggcgctatctatgttaaagaagctaccctattcaatgctctagacagcctcaaatttgaaaaaaacacttctgggcaagctggtggtggaatctatacagagtctacgctcacaatctcgaacatcacaaaatctattgaatttatctctaataaagcttctgtccctgcccccgctcctgagcccacctctccggctccaagtagcttaataaattctacaacgatcgatacctcgactctccaaacccgagcagcatccgcaactccagcagtggctcctgttgctgccgtaactccaacaccaatctctactcaagagaccgcaggaaatggaggcgctatctatgctaaacaaggtatttcgatatccacgtttaaagatctgaccttcaagtctaactctgcatcggtagatgccacccttactgtcgattctagcactattggagaatctggaggtgctatctttgcagcagactctatacaaatccaacagtgcacgggaaccaccttattcagtggcaatactgccaataagtctggtgggggtatttacgctgtaggacaagtcaccctagaagatatagcgaatctgaagatgaccaacaacacctgtaaaggtgaaggtggagccatctacactaaaaaggctttaactatcaacaacggtgccattctcactacattttctggaaatacatcgacagataatggtggggctatttttgctgtaggtggcatcactctctctgatcttgtagaagtccgctttagtaaaaataagaccggaaattattccgctcctattaccaaagcggctagcaacacagctcctgtagtttctagctctacaactgctgcatctcctgcggtccctgctgccgctgcagcacctgttacaaacgcagcaaaaggaggggctttatatagtacagaaggactgactgtatctggaatcacatcgatattgtcgtttgaaaacaacgaatgccagaatcaaggaggtggggcttacgttactaaaaccttccagtgttccgattctcatcgcctccagtttactagtaataaagcagcagatgaaggcgggggcctgtattgtggtgacgatgtcacgctaacgaacctgacagggaaaacactatttcaagagaatagcagtgagaaacatggaggtgggctctctctcgcctcaggaaaatctctgactatgacatcgttagagagcttctgcttaaatgcaaatacagcaaaggaaaacggaggcggtgcgaatgtccctgaaaatattgtactcaccttcacctatactcccactccaaatgaacctgcgcctgtgcagcagcccgtgtatggagaagctcttgttactggaaatacagccacaaaaagtggtgggggcatttacacgaaaaatgcggccttctcaaatttatcttctgtaacttttgatcaaaatacctcttcagaaaatggtggtgccttacttacccaaaaagctgcagataaaacggactgttctttcacctatattacaaatgtcaatatcaccaacaatacagctacaggaaatggtgggggcattgctgggggaaaagcacattttgatcgcattgataatcttacagtccaaagcaaccaagcaaagaaaggtggtggggtttatcttgaagatgccctcatcctggaaaaggttattacaggttctgtctcacaaaatacagctacagaaagtggtgggggtatctacgctaaggatattcaactacaagctctacctggaagcttcacaattaccgataataaagtcgaaactagtcttactactagcactaatttatatggtgggggcatctattccagtggagctgtcacgctaaccaatatatctggaacctttggcattacaggaaactctgttatcaatacagcgacatcccaggatgcagatatacaaggtgggggcatttatgcaaccacgtctctctcaataaatcaatgtaatacacccattctatttagcaacaactctgctgccactaaaaaaacatcaacaacaaagcaaattgctggtggggctatcttctccgctgcagtaactatcgagaataactctcagcccattattttcttaaataattccgcaaagtcggaagcaactacagcagcaactgcaggaaataaagatagctgtggaggagccattgcagctaactctgttactttaacaaataaccctgaaataacctttaaaggaaattatgcagaaactggaggagcgattggctgtattgatcttactaatggctcacctccccgtaaagtctctattgcagacaacggttctgtcctttttcaagacaactctgcgttaaatcgcggaggcgctatctatggagagactatcgatatctccaggacaggtgcgactttcatcggtaactcttcaaaacatgatggaagtgcaatttgctgttcaacagccctaactcttgcgccaaactcccaacttatctttgaaaacaataaggttacggaaaccacagccactacaaaagcttccataaataatttaggagctgcaatttatggaaataatgagactagtgacatcactatctctttatcagctgagaatggaagtattttctttaaaaacaatctatgcacagcaacaaacaaatactgcagtattgctggaaacgtaaaatttacagcaatagaagcttcagcagggaaagctatatctttctatgatgcagttaacgtttccaccaaagaaacaaatgctcaagagctaaaattaaatgaaaaagcgacaagtacaggaacgattctattttctggggaacttcacgaaaataaatcctatattccacagaaagtcactttcgcacatgggaatctcattctaggtaaaaatgcagaacttagcgtagtttcctttacccaatctccaggcaccacaatcactatgggcccaggatcggttctttccaaccatagcaaagaagcaggaggaatcgctataaacaatgtcatcattgattttagtgaaatcgttcctactaaagataatgcaacagtagctccacccactcttaaattagtatcgagaactaatgcagatagtaaagataagattgatattacaggaactgtgactcttctagatcctaatggcaacttatatcaaaattcttatcttggtgaagaccgcgatatcactcttttcaatatagacaattctgcaagtggggcagttacagccacgaatgtcacccttcaagggaatttaggagctaaaaaaggatatttaggaacctggaatttggatccaaattcctcgggttcaaaaattattctaaaatggacctttgacaaatacctgcgctggccctacatccctagagacaaccacttctacatcaactctatttggggagcacaaaactctttagtgactgtgaaacaagggatcttagggaacatgttgaacaatgcaaggtttgaagatcctgctttcaacaacttctgggcttcggctataggatctttccttaggaaagaagtatctcgaaattctgactcattcacctatcatggcagaggctataccgctgctgtggatgccaaacctcgccaagaatttattttaggagctgccttcagtcaggtttttggtcacgccgagtctgaatatcaccttgacaactataagcataaaggctcaggtcactctacacaagcatctctttatgctggcaatatcttctattttcctgcgatacggtctcggcctattctattccaaggtgtggcgacctatggttatatgcaacatgacaccacaacctactatccttctattgaagaaaaaaatatggcaaactgggatagcattgcttggttatttgatctgcgtttcagtgtggatcttaaagaacctcaacctcactctacagcaaggcttaccttctatacagaagctgagtataccagaattcgccaggagaaattcacagagctagactatgatcctagatctttctctgcatgctcttatggaaacttagcaattcctactggattctctgtagacggagcattagcttggcgtgagattattctatataataaagtatcagctgcgtacctccctgtgattctcaggaataatccaaaagcgacctatgaagttctctctacaaaagaaaagggcaacgtagtcaacgttctccctacaagaaacgcagctcgtgcagaggtgagctctcaaatttatcttggaagttactggacactctacggcacgtatactattgatgcttcaatgaatactttagtgcaaatggccaacggagggatccggtttgtattctag

SEQ ID NO: 376 - DNA, 3759 bp, Chlamydia pneumoniae
atgttgaagtgccctgaacgggtcagtgttaaaaaaaaggaagatatcccagaccttccaaatcttatcgaaatccaaattaagtcttataagcagtttcttcaaattggaaaattagcagaagaaagagaaaatatcggtttagaagaggttttcagggaaatttttcccattaaatcctataacgaagctaccgttcttgagtacctttcatataatttgggtgtgccaaaatattctccagaagaatgtatccgtagaggaattacctatagcgtcactttgaaagtccgttttcgtttaaccgatgaaacgggaatcaaagaagaagaagtctatatgggaacgatccctctaatgactgataaagggacatttatcattaatggagctgaaagagtcgttgtttcccaagttcatcgttctccaggaattaactttgaacaagaaaaacattccaaaggtaatattttattctccttcagaatcattccttatcgtggaagttggctcgaagctattttcgatattaatgacttaatttatatccatattgatagaaaaaaacgtagaagaaaaattctagcaatcacctttatccgagctcttggatactcttcagatgcagatatcatcgaagaattcttcacaataggagaaagttctcttagaagtgagaaagactttgctcttcttgttggaaggattttagcagacaatattattgatgaagcctcctctctagtttatggaaaagccggagaaaagttaagtacagcaatgttaaaacggatgctcgatgctggaatcgcttctgttaagattgctgtagatgctgatgaaaatcatcctattatcaaaatgctcgctaaggatcctacagattcatacgaagccgctttaaaagatttttatcgtagactacgtccaggagaacctgcaactctagctaatgcacgttctactatcatgaggctcttctttgaccccaaacgttataatctaggacgtgtagggcgttataagctcaatcgcaaactaggcttctctatagatgatgaagctctgtctcaagttactttgagaaaagaagatgtgatcggagccttaaagtatctgattcgtttgaaaatgggagatgaaaaagcttgtgtagacgatattgatcatcttgctaatcgacgtgtccgctctgtcggagaactcattcaaaatcaatgtcgttcaggacttgctagaatggagaaaattgttagagagagaatgaatttattcgatttctcctcagatacgttgactccaggaaaagttgtctctgctaaaggtctcgctagcgtgttaaaagatttctttggccgctcccagctttcgcagtttatggaccaaaccaaccctgtagctgagttaactcacaaacgacgtctttctgcattaggtccaggaggactaaatagagaacgcgcaggatttgaagttcgtgacgtgcacgcaagtcattatggacgtatttgtcctattgaaactcctgaaggtccaaatattggtctgatcacctctctttcctcttttgctaaaattaacgaatttggattcattgaaactccttatagaattgtaagagatggaatcgtaacagatgaaatcgaatacatgacagccgatgttgaagaagaatgtgtgattgcacaggcttcagcaagcctagatgagtacaatatgtttacggaacccgtctgttgggtacgttatgctggagaagctttcgaagcagatacaagcaccgtaacccatatggatgtttctccgaaacagctcgtttctattgttacaggattgattcctttcttagagcacgacgatgcgaaccgcgccttgatgggctccaatatgcaacgtcaagcggttcccttacttaaaaccgaagctcctgttgttggcactggattagaatgtcgtgctgctaaagattctggagctattgttgttgcagaagaagatggtgttgttgattttgttgatggttacaaagtagttgttgctgcaaaacataatcctacaattaaacgtacctatcatctgaaaaagttccttagatctaattcaggaacttgcattaaccaacagcccttgtgtgcagtcggtgatgtcataactaagggtgatgtgattgctgatggacccgcaactgatcgtggagaacttgctttaggtaaaaatgtactcgttgcctttatgccttggtatggatacaactttgaggatgcgatcattatctctgaaaaattgatcagagaagatgcctatacctctatttatattgaggaattcgaactaacagcccgagatacaaaattaggaaaagaagagatcactcgtgacattcctaacgtatctgatgaagtattggccaatctcggtgaggatgggatcattcgtatcggtgctgaggttaaacctggggatattcttgttggtaagatcacaccaaaatcagaaacagaattagctccagaagagcgtctgctccgtgctatttttggtgaaaaagctgctgacgttaaagatgcatctttaacagtgcctccaggaactgaaggcgtcgttatggatgttaaagtcttcagtagaaaggatagattgtcaaagagtgatgacgaacttgtagaagaagctgttcatcttaaagatttgcaaaaaggatataaaaaccaagttgcaactttaaaaacagaatatcgtgagaaattaggagctctcttattaaatgagaaagcacctgcagccattattcaccgtcgtacagcagaaatcgttgttcatgaaggcctactctttgatcaagagacaatagaacggatagaacaagaagatttagtggatcttttaatgcctaactgtgaaatgtatgaagtgttgaaaggacttctatcagattacgaaacggcattacaacggctagaaatcaattataagactgaagttgagcatattcgtgagggagatgcagatttagatcatggtgtcattcgccaagttaaagtctacgttgcctctaagagaaaacttcaagttggagataaaatggctggacgacacggaaataaaggtgttgtttccaaaatcgttcccgaagcggatatgccatatctctctaacggagaaactgtacaaatgatcctgaaccccctcggggtgccttcaaggatgaaccttggacaggtattagaaacacacctaggttatgcagcaaaaactgcaggcatttacgtgaaaacccctgtttttgaaggattccctgaacaacgtatctgggatatgatgatagaacagggattaccagaagatgggaagtccttcttatatgatgggaagacaggtgaacgctttgataacaaggtagtgataggctatatctatatgctaaagctcagtcacttgatcgctgataagattcacgcaagatctatagggccatattctttagtcacgcaacaacctctcggtggtaaagctcagatgggaggacaaagattcggggaaatggaagtttgggctctagaagcatatggggttgctcatatgctccaagaaattctaaccgtgaaatctgatgatgtctcaggaagaacaaggatttacgaatctatcgttaagggggaaaacctcttgcgatcaggaacgcctgagtcgttcaatgtgctaattaaagagatgcagggtctaggacttgatgttcgtcctatggtcgtagacgcttaa

SEQ ID NO: 377 - DNA, 675 bp, Chlamydia pneumoniae
atgacatcctggatagaattacttgataagcaaattgaagatcaacatatgttaaagcacgaattttatcagcgttggtctgaaggaaagttagaaaaacaacaacttcaagcttatgccaaagattactatttacatattaaagcatttccttgttacctttcagcgctgcatgctcgctgtgatgacttgcagattcgtagacaaattcttgagaatctcatggatgaagaagctggaaatcctaatcacatagatttatggagacagtttgctttatctcttggagtttctgaagaggagcttgccaatcatgaattcagtcaggctgctcaagatatggtagcgacatttcgccgcttatgcgacatgccacaacttgccgtgggtttaggcgctctctatacttatgagattcagattcctcaagtctgtgtagagaaaatccgtggtttgaaagaatattttggagtttctgctcgaggctatgcatactttactgtacatcaagaagctgatattaaacatgccagcgaagagaaagaaatgctacaaactttggtaggcagagagaatcctgatgctgttttgcaaggatcacaagaagttttagatactctatggaactttttgagctcttttattaattcaacggagccttgttcttgtaagtag

SEQ ID NO: 378 - DNA, 1671 bp, Chlamydia pneumoniae
atgtccaaactcatcagacgagtagttacggtccttgcgctaacgagtatggcgagttgctttgccagcgggggtatagaggccgctgtagcagagtctctgattactaagatcgtcgctagtgcggaaacaaagccagcacctgttcctatgacagcgaagaaggttagacttgtccgtagaaataaacaaccagttgaacaaaaaagccgtggtgctttttgtgataaagaattttatccctgtgaagagggacgatgtcaacctgtagaggctcagcaagagtcttgctacggaagattgtattctgtaaaagtaaacgatgattgcaacgtagaaatttgccagtccgttccagaatacgctactgtaggatctccttaccctattgaaatccttgctataggcaaaaaagattgtgttgatgttgtgattacacaacagctaccttgcgaagctgaattcgtaagcagtgatccagaaacaactcctacaagtgatgggaaattagtctggaaaatcgatcgcctgggtgcaggagataaatgcaaaattactgtatgggtaaaacctcttaaagaaggttgctgcttcacagctgctactgtatgtgcttgcccagagctccgttcttatactaaatgcggtcaaccagccatttgtattaagcaagaaggacctgactgtgcttgcctaagatgccctgtatgctacaaaatcgaagtagtgaacacaggatctgctattgcccgtaacgtaactgtagataatcctgttcccgatggctattctcatgcatctggtcaaagagttctctcttttaacttaggagacatgagacctggcgataaaaaggtatttacagttgagttctgccctcaaagaagaggtcaaatcactaacgttgctactgtaacttactgcggtggacacaaatgttctgcaaatgtaactacagttgttaatgagccttgtgtacaagtaaatatctctggtgctgattggtcttacgtatgtaaacctgtggagtactctatctcagtatcgaatcctggagacttggttcttcatgatgtcgtgatccaagatacactcccttctggtgttacagtactcgaagctcctggtggagagatctgctgtaataaagttgtttggcgtattaaagaaatgtgcccaggagaaaccctccagtttaaacttgtagtgaaagctcaagttcctggaagattcacaaatcaagttgcagtaactagtgagtctaactgcggaacatgtacatcttgcgcagaaacaacaacacattggaaaggtcttgcagctacccatatgtgcgtattagacacaaatgatcctatctgtgtaggagaaaatactgtctatcgtatctgtgtaactaaccgtggttctgctgaagatactaacgtatctttaatcttgaagttctcaaaagaacttcagccaatagcttcttcaggtccaactaaaggaacgatttcaggtaataccgttgttttcgacgctttacctaaactcggttctaaggaatctgtagagttttctgttaccttgaaaggtattgctcccggagatgctcgcggcgaagctattctttcttctgatacactgacttcaccagtatcagacacagaaaatacccacgtgtattaa

SEQ ID NO: 379 - DNA, 1386 bp, Chlamydia pneumoniae
atgacccaagaatttgattgtgttgttattggtgcgggacctagtggctatgttgccgcaatcactgctgcgcaatcaaaattacggaccgctcttattgaagaagaccaggctggggggacctgcttaaaccgcggatgcatcccttcaaaagccctcattgctggagccaatgttgtatctcacattaagcatgcggagcagttcggcatccatgttgatggttatacaatcgattaccctgcgatggcaaaaagaaaaaatacagtcgtccaggggatccgtcaaggattagaaggattgatccgcagcaacaagattactgtcttaaaaggaaccggatctctagtatcttctacagaagttaaagttattggccaagacacgactataatcaaagccaatcatattatcctagctacaggatccgagcctcgtcctttcccaggggttcccttctcctctagaattttgagttccacagggatcttagaacttgaagtcctccctaaaaagctcgctattattggtggcggcgttattggctgtgaatttgcgtctctatttcacactttaggcgttgagattaccgttatagaagctttggatcatattcttgcggttaacaataaagaagtttctcaaaccgtaacgaataaatttacgaaacaaggaattcgaattcttaccaaagcctcgatctctgcaatcgaagaatcccaaaaccaagttcgcattactgtgaacgatcaagtggaagagtttgattatgtcttggtggctattggtcgccaatttaatacagcaagtatagggctagataatgctggagtgatccgggacgatcgtggcgtgattcctgttgacgaaaccatgcgcactaatgttccaaatatctatgcgattggagacatcactggaaagtggctacttgctcatgtggcttcgcaccaaggcgttattgccgcgaaaaatatttcgggacatcacgaagttatggattattctgccataccttctgtgatctttacccacccagaaattgctatggtaggtctatctctacaagaagcagaacaacaaaatcttcctgcaaagctcaccaaatttccttttaaagcgattggaaaagctgttgctttgggagcatctgatggttttgctgctattgtgagtcatgaaattacccagcaaatactcggagcttatgtcataggacctcacgcctcatcattaattggagagatgaccttagcgatccgcaatgagctgaccctaccttgcatatatgaaaccgtgcatgctcatcccacactctctgaagtttgggctgaaggtgctttacttgctacaaatcaccctttacacttccctcctaagtcatga

SEQ ID NO: 380 - DNA, 1635 bp, Chlamydia pneumoniae
atggcagcgaaaaatattaaatataatgaagaagccagaaaaaaaatacataaaggggtaaaaactcttgcagaagcagtaaaagttactctaggtcctaaaggacgtcacgtagttatagataagagctttggctctccccaagtgactaaagatggtgttactgtagctaaagaaatcgagctcgaagacaaacatgaaaacatgggcgctcagatggtaaaagaagtcgccagcaaaactgctgacaaagcaggcgacggaactacaacagcaactgttcttgcagaagcaatctatagcgaaggtctaagaaatgtcactgccggtgccaatcctatggacctaaaaagaggtatcgacaaagccgtaaaagttgttgttgatgaactcaaaaaaattagtaaacctgtacaacatcacaaagaaatcgctcaagtagctactatctcagcaaataatgattccgaaatcggaaatcttattgcagaagctatggaaaaagttggtaaaaacggatccattactgttgaagaagctaaaggcttcgaaactgttctcgacgttgtagaaggaatgaacttcaaccgtggatacctctccagctacttctccacaaatccagaaactcaagaatgcgttttagaagacgctctgattctaatctacgataaaaaaatctctggaattaaagacttccttccagttttacaacaagtagcagaatctggacgccctcttttaatcattgcagaagaaattgaaggagaagctttagcaactctagtagtcaatagactccgtgcaggattcagagtctgtgcagtgaaagctcctggtttcggtgacagaagaaaagctatgttagaagacatcgctatccttactggtggccaactagttagcgaagaacttggcatgaaactagagaatacaactctagcaatgttaggaaaagctaagaaagttatcgtaactaaagaagataccacaatcgtcgaaggcttaggaaacaaacctgatatccaagctcgatgcgacaatattaaaaaacaaatcgaagatagcacttcagattacgacaaagaaaaactccaagagcgtttagctaaactctccggtggtgtcgccgtaatccgcgtaggagctgctaccgaaatagagatgaaagagaaaaaagacagagtagatgatgcacaacacgcaaccattgcagctgtcgaagaaggaatcctccctggtggtggaactgccttagttcgctgtatccctacactagaagctttccttcctatgctagcaaacgaagacgaagctattggtactcgtattattctaaaagcattaacagctccattaaagcaaattgcaagtaacgcaggtaaagaaggcgctatcatttgtcagcaagttctagcaagatctgcaaatgaaggctatgatgctttacgtgacgcttatacagatatgattgacgcaggaattttagatccaactaaagtgactcgctcagctctagaaagcgcagcttctatcgcaggattactcctcacaacagaagccttaatcgctgatatcccagaagagaaatcttcttcagctccagcgatgccaagcgcaggaatggactactag

SEQ ID NO: 381 - DNA, 1995 bp, Chlamydia pneumoniae
atggaaaaagtttcttcttatccctcagttcctttacctcttggggcttctaaaatttccccaaaccgctatcgatttgctttatatgcttcacaagctaccgaagtcatccttgctttaacagacgaaaattcagaagtcatagaagtccctctttaccccgatacacaccgcacgggtgcgatttggcatatagagatcgagggtatttctgatcaatcgtcttatgcatttcgtgttcatgggcctaaaaagcatggaatgcaatactcttttaaagaatatcttgcagatccctatgcgaagaatattcattccccacagagttttggttcgcgaaagaaacagggggattatgcattttgttatttaaaggaagaaccatttccttgggatggtgatcagcctctgcatttgccgaaagaagagatgatcatctatgagatgcatgtacgttccttcacgcaatcttcttcatctagggttcatgctccgggaaccttcctaggaatcattgaaaagatcgaccatctgcataagctgggaatcaacgctgttgaactcttacctatctttgagttcgatgagactgcgcatccttttagaaattcgaaattcccttatctgtgcaattattggggttatgctcccctaaatttcttttctccttgccgacgttatgcttatgcctctgatccttgcgctccaagtagagagtttaaaactttagtaaagaccttgcatcaagaaggtattgaggtcattcttgatgttgtttttaatcatacgggcttgcaagggacgacctgctctttgccttggatagacactccgagctattatattttagatgcacaaggtcactttacaaattattcaggctgtggaaacactctcaatacaaaccgcgcccccacgacccaatggattctcgacatcttacgttattgggtagaagaaatgcatgtcgatgggttccgatttgatcttgcttctgtcttttctcgtggtccttcgggatctcccctacaattcgctcctgttttagaggcgatttcttttgatcctttacttgcgagcacaaagattatagctgagccttgggatgctggcggtttgtatcaggtgggctatttccccacactgtctccaagatggagtgaatggaacggcccgtatcgtgataacgtgaaagcatttcttaatggggatcaaaatctcataggaacctttgcttctagaatttcaggatctcaagacatctatcctcacggctcgcctacaaattcgattaactatgtcagttgccatgatggttttacgttatgtgacactgtgacttataaccacaaacataatgaggctaacggagaggataatcgtgacggcacagatgcgaactacagctacaatttcggaacggaagggaaaacagaagaccctggcattcttgaagttcgtgaaagacagttacgaaattttttccttactttgatggtctcgcaaggcattccgatgattcaatcaggagatgagtatgcccataccgcggaaggcaataacaaccgttgggctttggattcgaatgcgaattacttcctttgggatcagcttaccgcaaagcctacactgatgcactttctctgtgatctcattgcgtttcgaaaaaaatataaaacactttttaatcgaggctttctttccaataaggaaatcagttgggtagatgctatgggaaatcccatgacatggcgccctggaaatttcttagcatttaaaataaaatcgccaaaagcgcatgtatatgttgcttttcacgtgggagctcaagaccaacttgcgaccttacctaaagcctccagcaactttcttccttatcaaatagttgccgagagtcagcaagggtttgtccctcaaaatgtagcaacgccgacagtgtcgctacagccccataccacgctaattgcgatcagccatgcgaaagaggttacctga

SEQ ID NO: 382 - DNA, 987 bp, Chlamydia pneumoniae
atggcattcaaagaggtcgttcgtgttgctgtcacaggaggcaaagggcagattgcgtataattttttatttgcattagcccatggagatgtttttggagtggatcgtggtgtagatttacggatctatgatgtgccgggtacagagagagctctctcaggggtgcgtatggagctcgatgacggtgcatatcctcttttacatcgtctgcgtgtgacgacatcgttaaacgacgcttttgatggtatcgatgcggcgtttctgataggtgctgtgcctcgtggacccggtatggagcgaggagatcttttaaagcaaaatggtcagatcttttcgttacagggggccgctttaaatacagcagcaaaaagagatgctaagatttttgttgtagggaaccctgtcaatacgaattgctggattgctatgaaacatgctcccagattgcatcggaaaaatttccatgcgatgttacgcttggatcagaatcgcatgcatagcatgctcgctcatcgtgctgaggttcctctagaggaggtctcccgtgttgtcatctggggaaatcattctgcaaagcaggttcctgacttcacacaagcacgtatctcagggaaacccgcagccgaggttatcggagatcgagattggttggaaaacattttagtacactccgtgcagaatcgtggaagcgctgtaattgaagcaagagggaaatcttcggcagcatccgcatctcgagcacttgccgaggccgcgcgatctattttttgtcctaaaagtgacgagtggttttcttctggagtgtgttcggatcataatccttatggtattcctgaagacttgatttttggttttccatgtcgtatgttgccttctggagattatgaaatcattcctggattgccttgggagccttttatcagaaataagattcaaatttccctggatgaaattgctcaggaaaaagctagcgtgtcttcgttataa

SEQ ID NO: 383 - DNA, 654 bp, Chlamydia pneumoniae
atgaaaagagtcatttataaaaccatattttgcgggttaactttacttacaagtttgagtagttgttccctggatcctaaaggatataacctagagacaaaaaactcgagggacttaaatcaagagtctgttatactgaaggaaaaccgtgaaacaccttctcttgttaagagactctctcgtcgttctcgaagactcttcgctcgacgtgatcaaactcagaaggatacgctgcaagtgcaagctaactttaagacctacgcagaaaagatttcagagcaggacgaaagagacctttctttcgttgtctcgtctgctgcagaaaagtcttcaatttcgttagctttgtctcagggtgaaattaaggatgctttgtaccgtatccgagaagtccaccctctagctttaatagaagctcttgctgaaaaccctgccttgatagaagggatgaaaaagatgcaaggccgtgattggatttggaatcttttcttaacacaattaagtgaagtattttctcaagcttggtctcaaggggttatctctgaagaagatatcgccgcatttgcctccaccttaggtttggactccgggaccgttgcgtccattgtccaaggggaaaggtggcccgagcttgtggatatagtgataacttaa

SEQ ID NO: 384 - DNA, 813 bp, Chlamydia pneumoniae
atgatcataataaaaaacaatgagctcatgataagacgttttttcaaaacgcttttccctccgggtcctcaatactctttatgttatgcttcgatcctgatcgttttgagttcccttgtttgtgttcctacattttgttggttatttctccctgaactgtctttatctaaattcaatccttctcccattaggaacctatttttagtttcctccactctatccaaagtccctcctactgcgattgcagaacatttacgtctttctgcggatgcacctacatatctccatgaattctctattaaagaagctgagtcgagcttgcatgctcttgggattttttcctctttagttatagaaaaatctcctgataataagggcattacaattttctataccttacaaacacctattgcttatgttgggaaccgatctaatacgttatgcaatctcgaggggagctgctttcttggtcaaccgtacttcccctctctgaatctccctcagatttttttctctcaagaagatttaaaaatgcaaaaactccctaaagaaaaaatgctttttaccaagattcttcttaaggagcttgctatggagtctccgaaaatcattgatttatctttatctgatgcataccctggagaaattatagtgacgctctcttcaggcagtctgttaagacttccaattaagaccttagatcgtgccttagacctgtataagcacatgaaaaaaagtcctgtaatcgagagcgaaaaacaatatgtctatgatttgcgttttccaaatttcttattattaaaagctctatga

SEQ ID NO: 385 - DNA, 1956 bp, Chlamydia pneumoniae
atggttaatcctattggtccaggtcctatagacgaaacagaacgcacacctcccgcagatctttctgctcaaggattggaggcgagtgcagcaaataagagtgcggaagctcaaagaatagcaggtgcggaagctaagcctaaagaatctaagaccgattctgtagagcgatggagcatcttgcgttctgcagtgaatgctctcatgagtctggcagataagctgggtattgcttctagtaacagctcgtcttctactagcagatctgcagacgtggactcaacgacagcgaccgcacctacgcctcctccacccacgtttgatgattataagactcaagcgcaaacagcttacgatactatctttacctcaacatcactagctgacatacaggctgctttggtgagcctccaggatgctgtcactaatataaaggatacagcggctactgatgaggaaaccgcaatcgctgcggagtgggaaactaagaatgccgatgcagttaaagttggcgcgcaaattacagaattagcgaaatatgcttcggataaccaagcgattcttgactctttaggtaaactgacttccttcgacctcttacaggctgctcttctccaatctgtagcaaacaataacaaagcagctgagcttcttaaagagatgcaagataacccagtagtcccagggaaaacgcctgcaattgctcaatctttagttgatcagacagatgctacagcgacacagatagagaaagatggaaatgcgattagggatgcatattttgcaggacagaacgctagtggagctgtagaaaatgctaaatctaataacagtataagcaacatagattcagctaaagcagcaatcgctactgctaagacacaaatagctgaagctcagaaaaagttccccgactctccaattcttcaagaagcggaacaaatggtaatacaggctgagaaagatcttaaaaatatcaaacctgcagatggttctgatgttccaaatccaggaactacagttggaggctccaagcaacaaggaagtagtattggtagtattcgtgtttccatgctgttagatgatgctgaaaatgagaccgcttccattttgatgtctgggtttcgtcagatgattcacatgttcaatacggaaaatcctgattctcaagctgcccaacaggagctcgcagcacaagctagagcagcgaaagccgctggagatgacagtgctgctgcagcgctggcagatgctcagaaagctttagaagcggctctaggtaaagctgggcaacaacagggcatactcaatgctttaggacagatcgcttctgctgctgttgtgagcgcaggagttcctcccgctgcagcaagttctatagggtcatctgtaaaacagctttacaagacctcaaaatctacaggttctgattataaaacacagatatcagcaggttatgatgcttacaaatccatcaatgatgcctatggtagggcacgaaatgatgcgactcgtgatgtgataaacaatgtaagtacccccgctctcacacgatccgttcctagagcacgaacagaagctcgaggaccagaaaaaacagatcaagccctcgctagggtgatttctggcaatagcagaactcttggagatgtctatagtcaagtttcggcactacaatctgtaatgcagatcatccagtcgaatcctcaagcgaataatgaggagatcagacaaaagcttacatcggcagtgacaaagcctccacagtttggctatccttatgtgcaactttctaatgactctacacagaagttcatagctaaattagaaagtttgtttgctgaaggatctaggacagcagctgaaataaaagcactttcctttgaaacgaactccttgtttattcagcaggtgctggtcaatatcggctctctatattctggttatctccaataa

SEQ ID NO: 386 - protein, 805 aa, Chlamydia pneumoniae
MDPKEKNYDASAITVLEGLQAVRERPGMYIGDTGITGLHHLVYEVVDNSIDEAMAGYCSRIDVRILEDGGIVIVDNGRGIPIEVHERESAKQGREVSALEVVLTVLHAGGKFDKDSYKVSGGLHGVGVSCVNALSEKLVATVFKDKKCYQMEFSRGIPVTPLQYVSVSDRQGTEIVFYPDPKIFSTCTFDRSILMKRLRELAFLNRGITIVFEDDRDVSFDKVTFFYEGGIQSFVSYLNQNKESLFSEPIYICGTRVGDDGEIEFEAALQWNSGYSELVYSYANNIPTRQGGTHLTGFSTALTRVINTYIKAHNLAKNNKLALTGEDIREGLTAVISVKVPNPQFEGQTKQKLGNSDVSSVAQQVVGEALTIFFEENPQIARMIVDKVFVAAQAREAAKKARELTLRKSALDSARLPGKLIDCLEKDPEKCEMYIVEGDSAGGSAKQGRDRRFQAILPIRGKILNVEKARLQKIFQNQEIGTIIAALGCGIGADNFNLSKLRYRRIIIMTDADVDGSHIRTLLLTFFYRHMTALIENECVYIAQPPLYKVSKKKDFRYILSEKEMDSYLLMLGTNESSILFKSTERELRGEALESFINVILDVESFINTLEKKAIPFSEFLEMYKEGIGYPLYYLAPATGMQGGRYLYSDEEKEEALAQEETHKFKIIELYKVAVFVDIQNQLKEYGLDISSYLIPQKNEIVIGNEDSPSCNYSCYTLEEVINYLKNLGRKGIEIQRYKGLGEMNADQLWDTTMNPEQRTLIHVSLKDAVEADHIFTMLMGEEVPPRREFIESHALSIRINNLDI

SEQ ID NO: 387 - protein, 295 aa, Chlamydia pneumoniae
MEKLLVTDIDGTITHQSHHLDKKVYERLYALHQAGWKLFFLTGRYYKYAARLFSDFDAPYLLGCQNGASVWSSTSSNLLYSKSLPSDLLCILQDCMEGATALFSVESGAPYGDHYYRFSPTPIAQDLHEYVDPRYFPNAKEREILFETRSLKDDYAFPSFAAAKVFGLRDEVIRIQKELERQEALTSVATMTLMRWPFDFRYAILFLTDKSVSKGKALDRVVNILYDGKKPFVMASGDDANDLDLIERGDFKIVMSSAPEEMHVHADFLAPPADKNGILSAWEAGVRYYDDLMSL

SEQ ID NO: 388 - protein, 78 aa, Chlamydia pneumoniae
MKEFLAYIIKNLVDRPEEVRIKEVQGTHTIIYELSVAKPDIGKIIGKEGRTIKAIRTLLVSVASRNNVRVSLEIMEEK

SEQ ID NO: 389 - protein, 478 aa, Chlamydia pneumoniae
MRDVSELFRTHFMHYASYVILERAIPHILDGLKPVQRRLLWTLFLMDDGKMHKVANIAGRTMALHPHGDAPIVEALVVLANKGYLIDTQGNFGNPLTGDPHAAARYIEARLSPLARETLFNTDLIAFHDSYDGREKEPDILPAKLPVLLLHGVDGIAVGMTTKIFPHNFAELLKAQIAILNDKKFTVFPDFPSGGLMDPSEYQDGLGSITLRASIDIINDKTLVVKQICPQSTTETLIRSIENAAKRGTIKIDTIQDFSTDVPHIEIKLPKGSRAKEMLPLLFEHTECQVILYSKPTVIYENKPVECSISEILKLHTTALQGYLEKELLLLQEQLTLDHYHKTLEYIFIKHKLYDSVREVLAINKKISADDLHQAVLHALEPWLHELATPVTKQDTSQLASLTIKKILCFNEEACTKELLAIEKKQAAIQKDLGRIKEVTVKYLKGLLERHGHLGERKTQITNFKTAKTSILKQQTLI

SEQ ID NO: 390 - protein, 257 aa, Chlamydia pneumoniae
MAFYSPSTISKYFIYSGAGNRFLLGETLPEVEDVRFLCQETRVDGFLYLKPSSCADAQLIIFNSDGSRPTMCGNGLRCAIAHLASQKGKSDISVSTDSGLYSGYFYSWDRVLVDMTLADWRASVHRLESRPDPLPKEVVCIHTGVPHAVVILPEISTLDLSILGPFLRYHQTFSPDGVNVNFVQILGHCQLRVRTYERGVEGETAACGTGALASALVVSNSYGWKESIQIHTWGGELMTVSQNRGRVYLQGSVTRDL

SEQ ID NO: 391 - protein, 191 aa, Chlamydia pneumoniae
MADGEVHKLRDIIEKELLEARRVFFSEPVTEKSASDAIKKLWYLELKDPGKPIVFVINSPGGSVDAGFAVWDQIKMLTSPVTTVVTGLAASMGSVLSLCAAPGRRFATPHSRIMIHQPSIGGPITGQATDLDIHAREILKTKARIIDVYVEATNQPRDIIEKAIDRDMWMTANEAKDFGLLDGILFSFNDL

SEQ ID NO: 392 - protein, 232 aa, Chlamydia pneumoniae
MTKHGKRIRGILKNYDFSKSYSLREAIDILKQCPPVRFDQTVDVSIKLGIDPKKSDQQIRGAVFLPNGTGKTLRILVFASGNKVKEAVEAGADFMGSDDLVEKIKSGWLEFDVAVATPDMMREVGKLGKVLGPRNLMPTPKTGTVTTDVAKAISELRKGKIEFKADRAGVCNVGVGKLSFESSQIKENIEALSSALIKAKPPAAKGQYLVSFTISSTMGPGISIDTRELMAS

SEQ ID NO: 393 - protein, 122 aa, Chlamydia pneumoniae; identical to SEQ ID NO: 30

SEQ ID NO: 394 - protein, 1723 aa, Chlamydia pneumoniae
MKWLPATAVFAAVLPALTAFGDPASVEISTSHTGSGDPTSDAALTGFTQSSTETDGTTYTIVGDITFSTFTNIPVPVVTPDANDSSSNSSKGGSSSSGATSLIRSSNLHSDFDFTKDSVLDLYHLFFPSASNTLNPALLSSSSSGGSSSSSSSSSSGSASAVVAADPKGGAAFYSNEANGTLTFTTDSGNPGSLTLQNLKMTGDGAAIYSKGPLVFTGLKNLTFTGNESQKSGGAAYTEGALTTQAIVEAVTFTGNTSAGQGGAIYVKEATLFNALDSLKFEKNTSGQAGGGIYTESTLTISNITKSIEFISNKASVPAPAPEPTSPAPSSLINSTTIDTSTLQTRAASATPAVAPVAAVTPTPISTQETAGNGGAIYAKQGISISTFKDLTFKSNSASVDATLTVDSSTIGESGGAIFAADSIQIQQCTGTTLFSGNTANKSGGGIYAVGQVTLEDIANLKMTNNTCKGEGGAIYTKKALTINNGAILTTFSGNTSTDNGGAIFAVGGITLSDLVEVRFSKNKTGNYSAPITKAASNTAPVVSSSTTAASPAVPAAAAAPVTNAAKGGALYSTEGLTVSGITSILSFENNECQNQGGGAYVTKTFQCSDSHRLQFTSNKAADEGGGLYCGDDVTLTNLTGKTLFQENSSEKHGGGLSLASGKSLTMTSLESFCLNANTAKENGGGANVPENIVLTFTYTPTPNEPAPVQQPVYGEALVTGNTATKSGGGIYTKNAAFSNLSSVTFDQNTSSENGGALLTQKAADKTDCSFTYITNVNITNNTATGNGGGIAGGKAHFDRIDNLTVQSNQAKKGGGVYLEDALILEKVITGSVSQNTATESGGGIYAKDIQLQALPGSFTITDNKVETSLTTSTNLYGGGIYSSGAVTLTNISGTFGITGNSVINTATSQDADIQGGGIYATTSLSINQCNTPILFSNNSAATKKTSTTKQIAGGAIFSAAVTIENNSQPIIFLNNSAKSEATTAATAGNKDSCGGAIAANSVTLTNNPEITFKGNYAETGGAIGCIDLTNGSPPRKVSIADNGSVLFQDNSALNRGGAIYGETIDISRTGATFIGNSSKHDGSAICCSTALTLAPNSQLIFENNKVTETTATTKASINNLGAAIYGNNETSDVTISLSAENGSIFFKNNLCTATNKYCSIAGNVKFTAIEASAGKAISFYDAVNVSTKETNAQELKLNEKATSTGTILFSGELHENKSYIPQKVTFAHGNLILGKNAELSVVSFTQSPGTTITMGPGSVLSNHSKEAGGIAINNVIIDFSEIVPTKDNATVAPPTLKLVSRTNADSKDKIDITGTVTLLDPNGNLYQNSYLGEDRDITLFNIDNSASGAVTATNVTLQGNLGAKKGYLGTWNLDPNSSGSKIILKWTFDKYLRWPYIPRDNHFYINSIWGAQNSLVTVKQGILGNMLNNARFEDPAFNNFWASAIGSFLRKEVSRNSDSFTYHGRGYTAAVDAKPRQEFILGAAFSQVFGHAESEYHLDNYKHKGSGHSTQASLYAGNIFYFPAIRSRPILFQGVATYGYMQHDTTTYYPSIEEKNMANWDSIAWLFDLRFSVDLKEPQPHSTARLTFYTEAEYTRIRQEKFTELDYDPRSFSACSYGNLAIPTGFSVDGALAWREIILYNKVSAAYLPVILRNNPKATYEVLSTKEKGNVVNVLPTRNAARAEVSSQIYLGSYWTLYGTYTIDASMNTLVQMANGGIRFVF

SEQ ID NO: 395 - protein, 1723 aa, Chlamydia pneumoniae
MKWLPATAVFAAVLPALTAFGDPASVEISTSHTGSGDPTSDAALTGFTQSSTETDGTTYTIVGDITFSTFTNIPVPVVTPDANDSSSNSSKGGSSSSGATSLIRSSNLHSDFDFTKDSVLDLYHLFFPSASNTLNPALLSSSSSGGSSSSSSSSSSGSASAVVAADPKGGAAFYSNEANGTLTFTTDSGNPGSLTLQNLKMTGDGAAIYSKGPLVFTGLKNLTFTGNESQKSGGAAYTEGALTTQAIVEAVTFTGNTSAGQGGAIYVKEATLFNALDSLKFEKNTSGQAGGGIYTESTLTISNITKSIEFISNKASVPAPAPEPTSPAPSSLINSTTIDTSTLQTRAASATPAVAPVAAVTPTPISTQETAGNGGAIYAKQGISISTFKDLTFKSNSASVDATLTVDSSTIGESGGAIFAADSIQIQQCTGTTLFSGNTANKSGGGIYAVGQVTLEDIANLKMTNNTCKGEGGAIYTKKALTINNGAILTTFSGNTSTDNGGAIFAVGGITLSDLVEVRFSKNKTGNYSAPITKAASNTAPVVSSSTTAASPAVPAAAAAPVTNAAKGGALYSTEGLTVSGITSILSFENNECQNQGGGAYVTKTFQCSDSHRLQFTSNKAADEGGGLYCGDDVTLTNLTGKTLFQENSSEKHGGGLSLASGKSLTMTSLESFCLNANTAKENGGGANVPENIVLTFTYTPTPNEPAPVQQPVYGEALVTGNTATKSGGGIYTKNAAFSNLSSVTFDQNTSSENGGALLTQKAADKTDCSFTYITNVNITNNTATGNGGGIAGGKAHFDRIDNLTVQSNQAKKGGGVYLEDALILEKVITGSVSQNTATESGGGIYAKDIQLQALPGSFTITDNKVETSLTTSTNLYGGGIYSSGAVTLTNISGTFGITGNSVINTATSQDADIQGGGIYATTSLSINQCNTPILFSNNSAATKKTSTTKQIAGGAIFSAAVTIENNSQPIIFLNNSAKSEATTAATAGNKDSCGGAIAANSVTLTNNPEITFKGNYAETGGAIGCIDLTNGSPPRKVSIADNGSVLFQDNSALNRGGAIYGETIDISRTGATFIGNSSKHDGSAICCSTALTLAPNSQLIFENNKVTETTATTKASINNLGAAIYGNNETSDITISLSAENGSIFFKNNLCTATNKYCSIAGNVKFTAIEASAGKAISFYDAVNVSTKETNAQELKLNEKATSTGTILFSGELHENKSYIPQKVTFAHGNLILGKNAELSVVSFTQSPGTTITMGPGSVLSNHSKEAGGIAINNVIIDFSEIVPTKDNATVAPPTLKLVSRTNADSKDKIDITGTVTLLDPNGNLYQNSYLGEDRDITLFNIDNSASGAVTATNVTLQGNLGAKKGYLGTWNLDPNSSGSKIILKWTFDKYLRWPYIPRDNHFYINSIWGAQNSLVTVKQGILGNMLNNARFEDPAFNNFWASAIGSFLRKEVSRNSDSFTYHGRGYTAAVDAKPRQEFILGAAFSQVFGHAESEYHLDNYKHKGSGHSTQASLYAGNIFYFPAIRSRPILFQGVATYGYMQHDTTTYYPSIEEKNMANWDSIAWLFDLRFSVDLKEPQPHSTARLTFYTEAEYTRIRQEKFTELDYDPRSFSACSYGNLAIPTGFSVDGALAWREIILYNKVSAAYLPVILRNNPKATYEVLSTKEKGNVVNVLPTRNAARAEVSSQIYLGSYWTLYGTYTIDASMNTLVQMANGGIRFVF

SEQ ID NO: 396 - protein, 1252 aa, Chlamydia pneumoniae
MLKCPERVSVKKKEDIPDLPNLIEIQIKSYKQFLQIGKLAEERENIGLEEVFREIFPIKSYNEATVLEYLSYNLGVPKYSPEECIRRGITYSVTLKVRFRLTDETGIKEEEVYMGTIPLMTDKGTFIINGAERVVVSQVHRSPGINFEQEKHSKGNILFSFRIIPYRGSWLEAIFDINDLIYIHIDRKKRRRKILAITFIRALGYSSDADIIEEFFTIGESSLRSEKDFALLVGRILADNIIDEASSLVYGKAGEKLSTAMLKRMLDAGIASVKIAVDADENHPIIKMLAKDPTDSYEAALKDFYRRLRPGEPATLANARSTIMRLFFDPKRYNLGRVGRYKLNRKLGFSIDDEALSQVTLRKEDVIGALKYLIRLKMGDEKACVDDIDHLANRRVRSVGELIQNQCRSGLARMEKIVRERMNLFDFSSDTLTPGKVVSAKGLASVLKDFFGRSQLSQFMDQTNPVAELTHKRRLSALGPGGLNRERAGFEVRDVHASHYGRICPIETPEGPNIGLITSLSSFAKINEFGFIETPYRIVRDGIVTDEIEYMTADVEEECVIAQASASLDEYNMFTEPVCWVRYAGEAFEADTSTVTHMDVSPKQLVSIVTGLIPFLEHDDANRALMGSNMQRQAVPLLKTEAPVVGTGLECRAAKDSGAIVVAEEDGVVDFVDGYKVVVAAKHNPTIKRTYHLKKFLRSNSGTCINQQPLCAVGDVITKGDVIADGPATDRGELALGKNVLVAFMPWYGYNFEDAIIISEKLIREDAYTSIYIEEFELTARDTKLGKEEITRDIPNVSDEVLANLGEDGIIRIGAEVKPGDILVGKITPKSETELAPEERLLRAIFGEKAADVKDASLTVPPGTEGVVMDVKVFSRKDRLSKSDDELVEEAVHLKDLQKGYKNQVATLKTEYREKLGALLLNEKAPAAIIHRRTAEIVVHEGLLFDQETIERIEQEDLVDLLMPNCEMYEVLKGLLSDYETALQRLEINYKTEVEHIREGDADLDHGVIRQVKVYVASKRKLQVGDKMAGRHGNKGVVSKIVPEADMPYLSNGETVQMILNPLGVPSRMNLGQVLETHLGYAAKTAGIYVKTPVFEGFPEQRIWDMMIEQGLPEDGKSFLYDGKTGERFDNKVVIGYIYMLKLSHLIADKIHARSIGPYSLVTQQPLGGKAQMGGQRFGEMEVWALEAYGVAHMLQEILTVKSDDVSGRTRIYESIVKGENLLRSGTPESFNVLIKEMQGLGLDVRPMVVDA

SEQ ID NO: 397 - protein, 224 aa, Chlamydia pneumoniae
MTSWIELLDKQIEDQHMLKHEFYQRWSEGKLEKQQLQAYAKDYYLHIKAFPCYLSALHARCDDLQIRRQILENLMDEEAGNPNHIDLWRQFALSLGVSEEELANHEFSQAAQDMVATFRRLCDMPQLAVGLGALYTYEIQIPQVCVEKIRGLKEYFGVSARGYAYFTVHQEADIKHASEEKEMLQTLVGRENPDAVLQGSQEVLDTLWNFLSSFINSTEPCSCK

SEQ ID NO: 398 - protein, 556 aa, Chlamydia pneumoniae [sequence omitted]

SEQ ID NO: 399 - protein, 461 aa, Chlamydia pneumoniae
MTQEFDCVVIGAGPSGYVAAITAAQSKLRTALIEEDQAGGTCLNRGCIPSKALIAGANVVSHIKHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 400 - protein, 544 aa, Chlamydia pneumoniae
MAAKNIKYNEEARKKIHKGVKTLAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDELKKISKPVQHHKEIAQVATISANNDSEIGNLIAEAMEKVGKNGSITVEEAKGFETVLDVVEGMNFNRGYLSSYFSTNPETQECVLEDALILIYDKKISGIKDFLPVLQQVAESGRPLLIIAEEIEGEALATLVVNRLRAGFRVCAVKAPGFGDRRKAMLEDIAILTGGQLVSEELGMKLENTTLAMLGKAKKVIVTKEDTTIVEGLGNKPDIQARCDNIKKQIEDSTSDYDKEKLQERLAKLSGGVAVIRVGAATEIEMKEKKDRVDDAQHATIAAVEEGILPGGGTALVRCIPTLEAFLPMLANEDEAIGTRIILKALTAPLKQIASNAGKEGAIICQQVLARSANEGYDALRDAYTDMIDAGILDPTKVTRSALESAASIAGLLLTTEALIADIPEEKSSSAPAMPSAGMDY

SEQ ID NO: 401 - protein, 664 aa, Chlamydia pneumoniae
MEKVSSYPSVPLPLGASKISPNRYRFALYASQATEVILALTDENSEVIEVPLYPDTHRTGAIWHIEIEGISDQSSYAFRVHGPKKHGMQYSFKEYLADPYAKNIHSPQSFGSRKKQGDYAFCYLKEEPFPWDGDQPLHLPKEEMIIYEMHVRSFTQSSSSRVHAPGTFLGIIEKIDHLHKLGINAVELLPIFEFDETAHPFRNSKFPYLCNYWGYAPLNFFSPCRRYAYASDPCAPSREFKTLVKTLHQEGIEVILDVVFNHTGLQGTTCSLPWIDTPSYYILDAQGHFTNYSGCGNTLNTNRAPTTQWILDILRYWVEEMHVDGFRFDLASVFSRGPSGSPLQFAPVLEAISFDPLLASTKIIAEPWDAGGLYQVGYFPTLSPRWSEWNGPYRDNVKAFLNGDQNLIGTFASRISGSQDIYPHGSPTNSINYVSCHDGFTLCDTVTYNHKHNEANGEDNRDGTDANYSYNFGTEGKTEDPGILEVRERQLRNFFLTLMVSQGIPMIQSGDEYAHTAEGNNNRWALDSNANYFLWDQLTAKPTLMHFLCDLIAFRKKYKTLFNRGFLSNKEISWVDAMGNPMTWRPGNFLAFKIKSPKAHVYVAFHVGAQDQLATLPKASSNFLPYQIVAESQQGFVPQNVATPTVSLQPHTTLIAISHAKEVT

SEQ ID NO: 402 - protein, 328 aa, Chlamydia pneumoniae
MAFKEVVRVAVTGGKGQIAYNFLFALAHGDVFGVDRGVDLRIYDVPGTERALSGVRMELDDGAYPLLHRLRVTTSLNDAFDGIDAAFLIGAVPRGPGMERGDLLKQNGQIFSLQGAALNTAAKRDAKIFVVGNPVNTNCWIAMKHAPRLHRKNFHAMLRLDQNRMHSMLAHRAEVPLEEVSRVVIWGNHSAKQVPDFTQARISGKPAAEVIGDRDWLENILVHSVQNRGSAVIEARGKSSAASASRALAEAARSIFCPKSDEWFSSGVCSDHNPYGIPEDLIFGFPCRMLPSGDYEIIPGLPWEPFIRNKIQISLDEIAQEKASVSSL

SEQ ID NO: 403 - protein, 217 aa, Chlamydia pneumoniae
MKRVIYKTIFCGLTLLTSLSSCSLDPKGYNLETKNSRDLNQESVILKENRETPSLVKRLSRRSRRLFARRDQTQKDTLQVQANFKTYAEKISEQDERDLSFVVSSAAEKSSISLALSQGEIKDALYRIREVHPLALIEALAENPALIEGMKKMQGRDWIWNLFLTQLSEVFSQAWSQGVISEEDIAAFASTLGLDSGTVASIVQGERWPELVDIVIT

SEQ ID NO: 404 - protein, 270 aa, Chlamydia pneumoniae
MIIIKNNELMIRRFFKTLFPPGPQYSLCYASILIVLSSLVCVPTFCWLFLPELSLSKFNPSPIRNLFLVSSTLSKVPPTAIAEHLRLSADAPTYLHEFSIKEAESSLHALGIFSSLVIEKSPDNKGITIFYTLQTPIAYVGNRSNTLCNLEGSCFLGQPYFPSLNLPQIFFSQEDLKMQKLPKEKMLFTKILLKELAMESPKIIDLSLSDAYPGEIIVTLSSGSLLRLPIKTLDRALDLYKHMKKSPVIESEKQYVYDLRFPNFLLLKAL

SEQ ID NO: 405 - protein, 651 aa, Chlamydia pneumoniae
MVNPIGPGPIDETERTPPADLSAQGLEASAANKSAEAQRIAGAEAKPKESKTDSVERWSILRSAVNALMSLADKLGIASSNSSSSTSRSADVDSTTATAPTPPPPTFDDYKTQAQTAYDTIFTSTSLADIQAALVSLQDAVTNIKDTAATDEETAIAAEWETKNADAVKVGAQITELAKYASDNQAILDSLGKLTSFDLLQAALLQSVANNNKAAELLKEMQDNPVVPGKTPAIAQSLVDQTDATATQIEKDGNAIRDAYFAGQNASGAVENAKSNNSISNIDSAKAAIATAKTQIAEAQKKFPDSPILQEAEQMVIQAEKDLKNIKPADGSDVPNPGTTVGGSKQQGSSIGSIRVSMLLDDAENETASILMSGFRQMIHMFNTENPDSQAAQQELAAQARAAKAAGDDSAAAALADAQKALEAALGKAGQQQGILNALGQIASAAVVSAGVPPAAASSIGSSVKQLYKTSKSTGSDYKTQISAGYDAYKSINDAYGRARNDATRDVINNVSTPALTRSVPRARTEARGPEKTDQALARVISGNSRTLGDVYSQVSALQSVMQIIQSNPQANNEEIRQKLTSAVTKPPQFGYPYVQLSNDSTQKFIAKLESLFAEGSRTAAEIKALSFETNSLFIQQVLVNIGSLYSGYLQ

SEQ ID NO: 406 - DNA, 1074 bp, Chlamydia trachomatis serovar D
gtgcgtaaaactgtcattgttgctatgtctggaggagtggattcctcggttgttgcttatctcttaaagaagcaaggggagtataatgttgttgggctcttcatgaaaaattggggagagcaggacgagaatggtgagtgtactgcaaccaaagattttcgcgatgtagagcggatcgcagaacaattgtccattccatattacacagtttccttttctaaggaatataaagagcgagtgttttctagatttctaagagaatatgcgaacggctacactcccaatcctgatgtgttatgcaatcgagaaatcaaatttgatttattacagaagaaggtacgtgagctaaaaggtgattttttagccacgggacattattgtcgaggaggggctgatggaactggtttgtccagaggaatagaccccaataaagaccaaagttatttcttatgtggcactcctaaggatgctttatccaatgtacttttccccctgggaggtatgtataaaacggaggtacgtcgaattgctcaagaagctggtttagctaccgccacaaaaaaagatagcacagggatttgcttcattggtaaacggccttttaagagtttccttgagcagtttgtagcagactctcctggagacattattgattttgatacacaacaggtagtcggccgacatgaaggagcccattattatacgattggacagcgtcgagggttaaacataggaggaatggaaaagccttgttatgttcttagcaagaatatggaaaagaatattgtttacattgtaaggggtgaagatcatcctttactttatcgacaagagcttttagctaaggaacttaattggtttgttcccttgcaggagcctatgatctgtagtgctaaagttcggtacagatcccctgacgagaaatgttctgtatatcctttggaagatggaacggtaaaagtgattttcgatgtccctgtgaaagctgtcacccctggacagactgtagctttctaccagggggacatttgtttaggaggaggagtgattgaagtgcctatgattcatcagctg

SEQ ID NO: 407 - DNA, 1827 bp, Chlamydia trachomatis serovar D
atgggtttttggagaacatcgattatgaaaatgaataggatttggctattactgcttaccttttcttctgccatacattctcctgtacaaggagaaagcttggtttgcaagaatgctcttcaagatttgagttttttagagcatttattacaggttaaatatgctcctaaaacatggaaagagcaatacttaggatgggatcttgttcaaagctccgtttctgcacagcagaagcttcgtacacaagaaaatccatcaacaagtttttgccagcaggtccttgctgattttatcggaggattaaatgactttcacgctggagtaactttctttgcgatagaaagtgcttaccttccttataccgtacaaaaaagtagtgacggccgtttctactttgtagatatcatgactttttcttcagagatccgtgttggagatgagttgctagaggtggatggggcgcctgtccaagatgtactcgctactctatatggaagcaatcacaaagggactgcagctgaagagtcggctgctttaagaacactattttctcgcatggcctctttagggcacaaagtaccttctgggcgcactactttaaagattcgtcgtccttttggtactacgagagaagttcgtgtgaaatggcgttatgttcctgaaggtgtaggagatttggctaccatagctccttctatcagggctccacagttacagaaatcgatgagaagctttttccctaagaaagatgatgcgtttcatcggtctagttcgctattctactctccaatggttccgcatttttgggcagagcttcgcaatcattatgcaacgagtggtttgaaaagcgggtacaatattgggagtaccgatgggtttctccctgtcattgggcctgttatatgggagtcggagggtcttttccgcgcttatatttcttcggtgactgatggggatggtaagagccataaagtaggatttctaagaattcctacatatagttggcaggacatggaagattttgatccttcaggaccgcctccttgggaagaatttgctaagattattcaagtattttcttctaatacagaagctttgattatcgaccaaacgaacaacccaggtggtagtgtcctttatctttatgcactgctttccatgttgacagaccgtcctttagaacttcctaaacatagaatgattctgactcaggatgaagtggttgatgctttagattggttaaccctgttggaaaacgtagacacaaacgtggagtctcgccttgctctgggagacaacatggaaggatatactgtggatctacaggttgccgagtatttaaaaagctttggacgtcaagtattgaattgttggagtaaaggggatatcgagttatcaacgcctattcctctttttggttttgagaagattcatccacatcctcgagttcaatactctaaaccgatttgtgttttgatcaatgagcaagacttttcttgtgctgacttcttccctgtagttttgaaagacaatgatcgagctcttattgttggtactcgaacagctggagctggaggatttgtctttaatgtgcagttcccaaatagaactggaataaaaacttgttctttaacaggatcattagctgttagagagcatggtgccttcattgagaacatcggagtcgaaccgcatatcgatctgccttttacagcgaatgatattcgctataaaggctattccgagtatcttgataaggtcaaaaaattggtttgtcagctgatcaataacgacggtaccattattcttgcggaagatggtagtttt

SEQ ID NO: 408 - DNA, 804 bp, Chlamydia trachomatis serovar D
ttgcccccccgctccccctcttttttagtacatatatggcgtcttttttttgctaaagggccgaattattctcttccctacgctttcctgtgtatcttcgttagcgttctcgtctttttacccatcggcttatggctgactctgcctagttttttaaatttcaagcactccctaacgcctattaagacattgtttcttacctgtacggagcctccttgccttcctgagccttttttctcggatatcttgcatctttctgctgattcccctccagctttacagacattttccacgaagtctgccgagcactttttaaatgaattaggagttttttcttttatttctattgagaaggttcctgatcataaaggcttagctatttcctatgctttgcatactccgttagcttttttaggaaatcaaactcatacattcataggttatgaaggacaaaccttcccagctttgcccttttttcaatccttagaactacctacagtcttcttttcgcaacaagctctttcccaaacacgcattccacatcaaacactgtctattgtcacgagcctaatagatcaactacagatggatcctcctagcatcattgacttatctcaaatcgatcattatccgggagaatttgtggtatccttatcttctggaacactcttacgttttcgtaaagactctttccttcctggaatccaacactatcaacaagcactctctctaggagccttctctcctcaacaagctgtcatttgcgaccttcgttgcgaagactatcttttacttaaacgtaaa

SEQ ID NO: 409 - DNA, 663 bp, Chlamydia trachomatis serovar D
atgaaaaagtttatctataagtatagctttggagctctcttgttgctctccgggctctccggattgagcagctgttgcgccaactcttatggatcgactcttgcaaaaaatacagccgagataaaagaagaatctgttacacttcgcgagaagccggatgccggctgtaaaaagaaatcttcttgttacttgagaaaatttttctcgcgcaagaaacctaaagagaagacagagcctgtgttgccgaactttaagtcttacgcagatccaatgacagattccgaaagaaaagacctttctttcgtagtatctgctgctgctgataagtcttctattgctttggctatggctcagggggaaattaaaggcgcattatcgcgtattagagagatccatcctcttgcattgttacaagctcttgcagaagatcctgctttaattgctggaatgaaaaagatgcaaggacgggattgggtctggaatatctttatcacagaattaagcaaagttttttctcaagcagcatctttaggggctttcagcgttgcagacgttgccgcgttcgcgtcgaccttaggattagactcggggaccgttacctcaattgttgatggggaaaggtgggctgagctgatcgatgtcgtgattcagaaccctgctata

SEQ ID NO: 410 - DNA, 1470 bp, Chlamydia trachomatis serovar D
atgagcgacctctcggacctatttaaaactcatttcacacagtatgcgtcttacgtcattttggaacgtgcaatccctcatgttttagatggcctcaagcctgttcaaagaaggcttctttggaccttattccgtatggatgatggtaaaatgcataaggtggctaatatcgcaggacgtacgatggcgctgcacccgcatggtgatgcgcctatcgtggaagctcttgtcgttttggcaaataaagggttcctgatagagacacaagggaactttggtaaccctctcacaggagatcctcatgcagcggctcgttatatagaagcgcggctaagccctttagctaaagaggtactttttaatacggatctcatgaccttccatgattcttacgatggaagagagcaagaacccgatatcttagctgcaaagattcctctactactccttcatggcgtggatggcatcgcagtagggatgactacaaaaattttccctcacaacttttgtgatctactagaagcacaaatagctatactgaatgaccaaccgttttctctccttcccgacttccctccaggaggcacgatggatgcttccgactaccaagatggcttaggatccattgttctgcgcgcaacaattgatattattaatgacaaaaccttgctaatcaaagaaatctgtccttccacaactacagagactctaattcgttctatcgaaaacgcagcaaaacgaggaatcattaaaatcgattcgattcaagatttctctacggacctccctcatatcgagatcaaactccctaaaggtatctacgctaaagatctgttacgccctctatatacacatacagaatgtcaggttatcttaacctctcggccaacagctatttaccagggaaaaccttgggaaacaacgatcagcgaaatcctacgcttacaaaccaagactctccaaaattacctaaaaaaagaattactcatactagaagattccttaagccgcgagctgtaccacaaaactttagaatatctattcattaaacataagctttacgataccgtgcgctccatgctttctaaaagaaagacgtctccttcatcaagtaccattcacaacgctgttttggaagctctgactccatttcttgacacgctcccggctcctgataagcaagcaaccgctcaactagcagctctaactattaaaaaaatcctctgttttgatgaaaattcctacgagaaggagctggcatgcttagaaaagaaacgcagtagcgtacagaaagatctgagccaactgaaaaaatacacagttctctacattaagaagctgctcgaaacctacagacaactcgggcatcgaaagacaaaaattgcaaaatttgatgacctacctaccgagagagtctccgctcataagaaagcaaaagaactcgctgcgctcgatcaagaagagaacttc

SEQ ID NO: 411 - DNA, 234 bp, Chlamydia trachomatis serovar D
atgaaagagtttttagcgtacattgtaaaaaatcttgttgataagccagaggaagtgcatctgaaagaggtgcagggaaccaatacgattatctacgaattgactgttgctaagggagatatcggtaaaattatcggtaaagaaggacgcactattaaggctatccgtactttattggtttccgtagcaagtcgagataatgtgaaagtcagcctagaaattatggaagagcgg

SEQ ID NO: 412 - DNA, 1941 bp, Chlamydia trachomatis serovar D
atggaatcaggaccagaatcagtttcttctaatcagagctcgatgaatccaattattaatgggcaaatcgcttctaattcggagaccaaagagtccacgaaggagtcagaagcgagtccttcagcatcgtcctctgtaagcagctggagttttttatcctcagcaaagcatgcattaatctctcttcgtgatgccatcttgaataaaaattctagtccaacagactctctctctcaattagaggcctctacttctacctctacggttacacgtgtagctgcgcgagattataatgaggctaaatcgaattttgatacggcgaaaagtggattagagaacgctacgacacttgctgaatacgagacgaaaatggctgatttaatggcagctctccaagatatggagcgtttggctaaacagaaggctgaagttacaagaattaaagaagctcttcaagagaaacaagaggttattgataagctcaatcagttagttaaacttgaaaaacagaatcagactttaaaggaaactttaacaaccacagactctgcagatcagattccagcgattaatagtcagttagagatcaacaaaaattctgcagatcaaattatcaaagatctggaaggacaaaacataagttatgaagctgttctcactaacgcaggagaggttatcaaagcttcttctgaagcgggaattaagttaggacaagctttgcagtctattgtggatgctggggatcaaagccaggctgcagttcttcaagcacagcaaaataatagcccagataatatcgcagccacgaagaaattaattgatgctgctgaaacgaaggtaaacgagttaaaacaagagcatacagggctaacggactcgcctttagtgaaaaaagctgaggagcagattagtcaagcacaaaaagatattcaagagatcaaacctagtggttcggatattcctatcgttggtccgagtgggtcagctgcttccgcaggaagtgcggtaggagcgttgaaatcctctaacaattcaggaagaatttccttgttgcttgatgatgtagacaatgaaatggcagcgattgcaatgcaaggttttcgatctatgatcgaacaatttaatgtaaacaatcctgcaacagctaaagagctacaagctatggaggctcagctgactgcgatgtcagatcaactggttggtgcggatggcgagctcccagccgaaatacaagcaatcaaagatgctcttgcgcaagctttgaaacaaccatcaacagatggtttagctacagctatgggacaagtggcttttgcagctgccaaggttggaggaggctccgcaggaacagctggcactgtccagatgaatgtaaaacagctttacaagacagcgttttcttcgacttcttccagctcttatgcagcagcactttccgatggatattctgcttacaaaacactgaactctttatattccgaaagcagaagcggcgtgcagtcagctattagtcaaactgcaaatcccgcgctttccagaagcgtttctcgttctggcatagaaagtcaaggacgcagtgcagatgctagccaaagagcagcagaaactattgtcagagatagccaaacgttaggtgatgtatatagccgcttacaggttctggattctttgatgtctacgattgtgagcaatccgcaagtaaatcaagaagagattatgcagaagctcacggcatctattagcaaagctccacaatttgggtatcctgctgttcagaattctgcggatagcttgcagaagtttgctgcgcaattggaaagagagtttgttgatggggaacgtagtctcgcagaatctcgagagaatgcgtttagaaaacagcccgctttcattcaacaggtgttggtaaacattgcttctctattctctggttatctttct

SEQ ID NO: 413 - DNA, 693 bp, Chlamydia trachomatis serovar D
atgatggaggtgtttatgaattttttagatcagttagatttaattattcaaaataagcatatgctagaacacacattttatgtgaaatggtcgaagggggagcttactaaagagcaattacaggcgtatgccaaagactattatttacatatcaaagcctttcctaaatatttatctgcgattcatagtcgttgcgatgatttagaggcgcgtaagttattgttagataacttgatggatgaagagaacggttaccctaatcatattgatttgtggaagcagtttgtgtttgctctaggagttactccagaagagttagaggctcatgagcctagtgaagcagcaaaagcgaaagtagctactttcatgcggtggtgtacaggagattctttagctgcaggagtggctgctttgtattcttatgagagtcaaattccacgtatcgctagagagaaaattcgtggattgactgagtactttggattttccaatcctgaagactatgcatatttcacagaacatgaagaagcggatgtgcggcatgctagagaagaaaaagcgctcattgagatgcttctcaaagatgacgctgataaagtgttagaggcatcgcaagaagtaacgcaatctttgtatggctttttagattcttttttggatccaggaacttgttgtagttgtcatcaatcttat

SEQ ID NO: 414 - DNA, 1599 bp, Chlamydia trachomatis serovar D
ttgtctaatagttttcgagaccaagaacaaggtttacaggcagtctttcgcgccgcgcgtgtaatatctcatatgttttctcagacaatcggtccttatgggtttagcacgattgttcataatgtccaggatacgcggacaacgcaagatagtcagagtatgctgaaggatattctgtttccagatgtctttgaaaatataggtatgaaactcatccgagatactgccttgcgaactcgtatgcgattcggagatggggcaaaaaccacagctttactaatagaagcgttattagcggagggcatgacaggtatccagaaaggtttggatcctcatgaaatccatcgaggaatgcttcttgcggaaaagaaaatccaagaggttttttatagagaaacatttcctctaagcgatctggaacatacagtgtatgtatccagtatcgcgcgacgttgtaatagcgaaatcgcgtctgttttatctagcgcagtgggttatggagggaagaacggttactatatcgtagaagaacatgaagagcatgaaacatactggcatgccgaagagcatgctgtgtgggattttggatatgcttctccttactttattacgcatgcggaaacaggaacggtagaatatagccaggtttatattttagttagtgaacagccgctgcattattcgaacccatcttttttaacatttcttcaatcagttgttcaggcagggaaaacaccgcttgtgattttagcagaagcttttgataaagaattattagctatgctggaaatgaatcaaatagagagggttttccctgtctgtgctgtgaaagtatctgggaagcacgcccgggaatctttagaggacattgcggtattaaccggagctacattgctctcagaaatggatttcgaagacagcgaggaagagagaatcacaaatcgattaggctttgtagcaggaatttgtgtttcttctaccagtctttgtgtccctagagaaacagacaataagcagagaatggcagaacactgtgcttttttacaggataaattgagtttctcacaggaagaagaggctagcgctaggttgagaaggagattggcaaggctttcttcaggcgaagtatgtattcatattgctgcagactgtattcctcaggaggagataggttatatcacctcttctatacgagccatgacagaatctttacgatcaggatgcttgcctggaggtgggtgcgcattcattcgagcggcaagagaaatttctgttccgcttgctctttctcctagtgagcgttttggttttcttgctgtgcttagtgccgcagagaagccttttcgtgccattgttactcgcagcagaagagtggaggaggaggtgttctctgaagtcttctctcaagcggactggcgagtaggatttaacggagtttctggatttgtggaagatattgtttcgcaagggatttgtgatggagcctcttgtattcagtatgctttaagtcatgcagtggggacgactggtctgttgttaacatctgcgctctttatagcttcgcaggagccgatgttgagagaggaaaattctgaagaa

SEQ ID NO: 415 - DNA, 1395 bp, Chlamydia trachomatis serovar D
atgaatgaagctttcgactgtgtagttatcggagcggggccagggggctatgttgcagcaatcactgccgctcaagcaggactcaaaactgcgctaatcgaaaagcgagaggctggcggaacctgtttaaaccgagggtgtattccttctaaagccctcttagcaggagctgaagtcgttacccaaatacgccatgctgaccagtttgggattcatgtagaaggattcagcatcaactatcccgctatggtacaaaggaaggattccgtagtccgtagcatccgcgatggacttaatggtctcattcgcagcaataagatcactgtcttctctggaagaggctctttgatctcttcaacagaagtaaaaatcttaggagaaaacccttctgtaatcaaagcgcactccattatcctagccaccggctctgaaccacgagctttccccgggattcctttttccgcagaatctcctcggattttatgctcaacaggcgtgctaaacctcaaagaaatccctcaaaaaatggccattattggcggtggtgtgatcggttgcgaattcgcttccttattccatacgttaggctccgaagtttctgtgatcgaagcaagctctcaaatccttgctttgaataatccagatatttcaaaaaccatgttcgataaattcacccgacaaggactccgtttcgtactagaagcctctgtatcaaatattgaggatataggagatcgcgttcggttaactatcaatgggaatgtcgaagaatacgattacgttctcgtatctataggacgccgtttgaatacagaaaatattggcttggataaagctggtgttatttgtgatgaacgcggagtcatccctaccgatgccacaatgcgcacaaacgtacctaacatttatgctattggagatatcacaggaaaatggcaacttgcccatgtagcttctcatcaaggaatcattgcagcacggaatatagctggccataaagaggaaatcgattactctgccgtcccttctgtgatctttaccttccctgaagtcgcttcagtaggcctatccccaacagcagctcaacaacaaaaaatccccgtcaaagtaacaaaattcccatttcgagctattggaaaagcggtcgcaatgggcgaggccgatggatttgcagccattatcagccatgagactactcagcagatcctaggagcttatgtgattggccctcatgcctcatcactgatttccgaaattaccctagcagttcgtaatgaactgactcttccttgtatttacgaaactatccacgcacatccaaccttagcagaagtttgggctgaaagtgcgttgttagctgttgataccccattacatatgccccctgctaaaaaa

SEQ ID NO: 416 - DNA, 366 bp, Chlamydia trachomatis serovar D
atgccacgcatcattggaatagatattcctgcgaaaaagaaattaaaaataagtcttacatatatttatggaatagggccagctctttctaaagagatcattgctagattgcagttgaatcccgaagctagagctgcagagttgactgaggaagaggttggtcgactaaacgctcttttacagtcggattacgttgttgaaggggatttgcgccgtcgtgtgcaatctgatatcaaacgtctgattactatccatgcttatcgtggacaaagacatagactttctttgcctgttcgtggtcagagaacaaaaacaaattctcgcacgcgtaagggtaaacgtaaaactgttgcaggtaagaagaaa

SEQ ID NO: 417 - DNA, 1659 bp, Chlamydia trachomatis serovar D
atgcgaataggagatcctatgaacaaactcatcagacgagcagtgacgatcttcgcggtgactagtgtggcgagtttatttgctagcggggtgttagagacctctatggcagagtctctctctacaaacgttattagcttagctgacaccaaagcgaaagacaacacttctcataaaagcaaaaaagcaagaaaaaaccacagcaaagagactcccgtagaccgtaaagaggttgctccggttcatgagtctaaagctacaggacctaaacaggattcttgctttggcagaatgtatacagtcaaagttaatgatgatcgcaatgttgaaatcacacaagctgttcctgaatatgctacggtaggatctccctatcctattgaaattactgctacaggtaaaagggattgtgttgatgttatcattactcagcaattaccatgtgaagcagagttcgtacgcagtgatccagcgacaactcctactgctgatggtaagctagtttggaaaattgaccgcttaggacaaggcgaaaagagtaaaattactgtatgggtaaaacctcttaaagaaggttgctgctttacagctgcaacagtatgcgcttgtccagagatccgttcggttacaaaatgtggacaacctgctatctgtgttaaacaagaaggcccagagaatgcttgtttgcgttgcccagtagtttacaaaattaatatagtgaaccaaggaacagcaacagctcgtaacgttgttgttgaaaatcctgttccagatggttacgctcattcttctggacagcgtgtactgacgtttactcttggagatatgcaacctggagagcacagaacaattactgtagagttttgtccgcttaaacgtggtcgtgctaccaatatagcaacggtttcttactgtggaggacataaaaatacagcaagcgtaacaactgtgatcaacgagccttgcgtacaagtaagtattgcaggagcagattggtcttatgtttgtaagcctgtagaatatgtgatctccgtttccaatcctggagatcttgtgttgcgagatgtcgtcgttgaagacactctttctcccggagtcacagttcttgaagctgcaggagctcaaatttcttgtaataaagtagtttggactgtgaaagaactgaatcctggagagtctctacagtataaagttctagtaagagcacaaactcctggacaattcacaaataatgttgttgtgaagagctgctctgactgtggtacttgtacttcttgcgcagaagcgacaacttactggaaaggagttgctgctactcatatgtgcgtagtagatacttgtgaccctgtttgtgtaggagaaaatactgtttaccgtatttgtgtcaccaacagaggttctgcagaagatacaaatgtttctttaatgcttaaattctctaaagaactgcaacctgtatccttctctggaccaactaaaggaacgattacaggcaatacagtagtattcgattcgttacctagattaggttctaaagaaactgtagagttttctgtaacattgaaagcagtatcagctggagatgctcgtggggaagcgattctttcttccgatacattgactgttccagtttctgatacagagaatacacacatctat

SEQ ID NO: 418 - DNA, 576 bp, Chlamydia trachomatis serovar D
atgcctgaaggggaaatgatgcataagttgcaagatgtcatagatagaaagttgttggattctcgtcgtattttcttctccgaacctgtaacggagaaaagtgctacagaagccatcaaaaagctttggtatttggaactcaccaatcctgggcagccaattgtatttgtcattaatagccctggagggtctgttgatgctgggtttgctgtttgggaccaaattaaaatgatctcttctcctttgactacagttgttacaggtttagcagcatctatgggatctgtattgagtttgtgtgctgttccaggaagacgttttgctacgcctcatgcgcgcattatgattcaccagccttctattggaggaaccattactggtcaagccacggacttggatattcatgctcgtgaaattttaaaaacaaaagcacgcattattgatgtgtatgtcgaggcaactggacaatctcgagaggtgatagagaaagctatcgatcgagatatgtggatgagtgcaaatgaagcaatggagtttggactgttagatgggattctcttctcttttaacgacttg

SEQ ID NO: 419 - DNA, 825 bp, Chlamydia trachomatis serovar D
atgggattctcttctcttttaacgacttgtagatatcttttatattctggagcaggaaacagtttcattttgggagaatcgatgccttctcttgaggatgttctgtttttatgccaggaagagatggttgatgggtttttatgtgtagagtcttctgaaatagcagatgctaaactcactgtttttaatagtgatggatctatcgcgtctatgtgcgggaatgggttgcggtgcgcaatggcgcacgtagcccagtgctttggacttgaagatgtttctattgaaacagaacgtggtgtttaccaaggtaagttcttttctatgaatcgggtattggttgatatgacattacctgattggaaaaaagctgagcggaaattaacgcatgtgttgcctggtatgccggaacaagtattttttattgatacaggggttccgcatgtcgtggttttcgtttctgatttaagtaaggttcccgtacaagaatgggggtctttcttgcgttatcatgaagattttgctcctgaaggtgtaaatgtagattttgttcagcggaagaaggatgatctactgcttgtctatacttatgagcgaggttgtgagcgagaaaccttatcttgtgggacagggatgttggcaagtgctttggttgcagcggatatcttttctctaggacaagatttctctatagcggtgtgttctcgtagtagaaatctgattaagattttttctgagaaaggcaaggtatttttagagggtcctgtgagcctattgaatcgtagtgagaactttgggtggttagagcctaaatcaagacgttttgga

SEQ ID NO: 420 - DNA, 5310 bp, Chlamydia trachomatis serovar D
atgaaatttatgtcagctactgctgtatttgctgcagcactctcctccgttactgaggcgagctcgatccaagatcaaataaagaataccgactgcaatgttagcaaattaggatattcaacttctcaagcatttactgatatgatgctagcagacaacacagagtatcgagctgctgatagtgtttcattctatgacttttcgacatcttccagattacctagaaaacatcttagtagtagtagtgaagcttctccaacgacagaaggagtgtcttcatcttcatctggagaaactgatgagaaaacagaagaagaactagacaatggcggaatcatttatgctagagagaaactaactatctcagaatctcaggactctctctctaatcaaagcatagaactccatgacaatagtattttcttcggagaaggtgaagttatctttgatcacagagttgccctcaaaaacggaggagctatttatggagagaaagaggtagtctttgaaaacataaaatctctactagtagaagtaaatatcgcggtcgagaaagggggtagcgtctatgcaaaagaacgagtatctttagaaaatgttaccgaagcaaccttctcctccaatggtggggaacaaggtggtggtggaatctattcagaacaggatatgttaatcagtgattgcaacaatgtacatttccaagggaatgctgcaggagcaacagcagtaaaacaatgtctggatgaagaaatgatcgtattgctcgcagaatgcgttgatagcttatccgaagatacactggatagcactccagaaacggaacagactgagtcaaatggaaatcaagacggttcgtctgaaacagaagatacacaagtatcagaatcaccagaatcaactcctagccccgacgatgttttaggtaaaggtggtggtatctatacagaaaaatctttgaccatcactggaattacagggactatagattttgtcagtaacatagctaccgattctggagcaggtgtattcactaaagaaaacttgtcttgcaccaacacgaatagcctacagtttttgaaaaactcggcaggtcaacatggaggaggagcctacgttactcaaaccatgtctgttactaatacaactagtgaaagtataactactccccctctcataggagaagtgattttctctgaaaatacagctaaagggcacggtggtggtatctgcactaacaaactttctttatctaatttaaaaacggtgactctcactaaaaactctgcaaaggagtctggaggagctatttttacagatctggcgtctataccaataacagataccccagaatcttctaccccctcttcctcctcgcctgcaagcactcctgaagtagttgcttctgctaaaataaatcgattctttgcctctacggcaaaaccggcagccccttctctaacagaggctgagtctgatcaaacggatcaaacagaaacttctgatactaatagcgatatagacgtgtcgattgagaacattttgaatgtcgctatcaatcaaaacacttctgcgaaaaaaggaggggctatttacgggaaaaaagctaaactttcccgtattaacaatcttgaactttcagggaattcatcccaggatgtaggaggaggtctctgtttaactgaaagcgtagaatttgatgcaattggatcgctcttatcccactataactctgctgctaaagaaggtggggctattcattctaaaacggttactctatctaacctcaagtctaccttcacttttgcagataacactgttaaagcaatagtagaaagcactcctgaagctccagaagagattcctccagtagaaggagaagagtctacagcaacagaagatccaaattctaatacagaaggaagttcggctaacactaaccttgaaggatctcaaggggatactgctgatacagggactggtgatgttaacaatgagtctcaagacacatcagatactggaaacgctgaatctgaagaacaactacaagattctacacaatctaatgaagaaaatacccttcccaatagtaatattgatcaatctaacgaaaacacagacgaatcatctgatagccacactgaggaaataactgacgagagtgtctcatcgtcctctgaaagtggatcatctactcctcaagatggaggagcagcttcttcaggggctccctcaggagatcaatctatctctgcaaacgcttgtttagctaaaagctatgctgcgagtactgatagctcccccgtatctaattcttcaggttcagaagagcctgtcacttcttcttcagattcagacgttactgcatcttctgataatccagactcttcctcatctggagatagcgctggagactctgaagaaccgactgagccagaagctggttctacaacagaaactcttactttaataggaggaggtgctatctatggagaaactgttaagattgagaacttctctggccaaggaatattttctggaaacaaagctatcgataacaccacagaaggctcctcttccaaatctgacgtcctcggaggtgcggtctatgctaaaacattgtttaatctcgatagcgggagctctagacgaactgtcaccttctccgggaatactgtctcttctcaatctacaacaggtcaggttgctggaggagctatctactctcctactgtaaccattgctactcctgtagtattttctaaaaactctgcaacaaacaatgctaataacactacagatactcagagaaaagacacctttggaggagctatcggagctacttctgctgtttctctatcaggaggggctcatttcttagaaaacgttgctgacctcggatctgctattgggttggtgccaggcacacaaaatacagaaacagtgaaattagagtctggctcctactactttgaaaaaaataaagctttaaaacgagctactatttacgcacctgtcgtttccattaaagcctatactgcgacatttaaccaaaacagatctctagaagaaggaagcgcgatttactttacaaaagaagcatctattgagtctttaggctctgttctcttcacaggaaacttagtaaccctaacgctaagcacaactacagaaggcacaccagccacaacctcaggagatgtaacaaaatatggtgctgctatctttggacaaatagcaagctcaaacggatctcagacggataaccttcccctgaaactcattgcttcaggaggaaatatttgtttccgaaacaatgaataccgtcctacttcttctgataccggaacctctactttctgtagtattgcgggagatgttaaattaaccatgcaagctgcaaaagggaaaacgatcagtttctttgatgcaatccggacctctactaagaaaacaggtacacaggcaactgcctacgatactctcgatattaataaatctgaggattcagaaactgtaaactctgcgtttacaggaacgattctgttctcctctgaattacatgaaaataaatcctatattccacaaaacgtagttctacacagtggatctcttgtattgaagccaaataccgagcttcatgttatttcttttgagcagaaagaaggctcttctctcgttatgacacctggatctgttctttcgaaccagactgttgctgatggagctttggtcataaataacatgaccattgatttatccagcgtagagaaaaatggtattgctgaaggaaatatctttactcctccagaattgagaatcatagacactactacaggtggaagcggtggaaccccatctacagatagtgaaagtaaccagaatagtgatgataccgaggagcaaaataataatgacgcctcgaatcaaggagaaagcgcgaatggatcgtcttctcctgcagtagctgctgcacacacatctcgtacaagaaactttgccgctgcagctacagccacacctacgacaacaccaacggctacaactacaacaagcaaccaagtaatcctaggaggagaaattaaactcatcgatcctaatgggaccttcttccagaaccctgcattaagatccgaccaacaaatctccttgttagtgctccctacagactcatcaaaaatgcaagctcagaaaatagtactgacgggtgatattgctcctcagaaaggatatacaggaacactcactctggatcctgatcaactacaaaatggaacgatctcagtgctctggaaatttgactcttatagacaatgggcttatgtacctagagacaatcatttctatgcgaactcgattctgggatctcaaatgttaatggtcacagtcaaacaaggcttgctcaacgataaaatgaatctagctcgctttgaggaagttagctataacaacctgtggatatcaggactaggaacgatgctatcgcaagtaggaacacctacttctgaagaattcacttattacagcagaggagcttctgttgccttagatgctaaaccagcccatgatgtgattgttggagctgcatttagtaagatgatcgggaaaacaaaatccttgaaaagagagaataactacactcacaaaggatccgaatattcttaccaagcatcggtatacggaggcaaaccattccactttgtaatcaataaaaaaacggaaaaatcgctaccgctattgttacaaggagtcatctcttacggatatatcaaacatgatacagtgactcactatccaacgatccgtgaacgaaacaaaggagaatgggaagacttaggatggctgacagctctccgtgtctcctctgtcttaagaactcctgcacaaggggatactaaacgtatcactgtttacggagaattggaatactccagtatccgtcagaaacaattcacagaaacagaatacgatcctcgttacttcgacaactgcacctatagaaacttagcaattcctatggggttagcattcgaaggagagctctctggtaacgatattttgatgtacaacagattctctgtagcatacatgctatcaatctatcgaaattctccaacatgcaaataccaagtgctctcttcaggagaaggcggagaaattatttgtggagtaccgacaagaaactcagctcgcggagaatacagcacgcagctgtacctgggacctttgtggactctgtatggatcctacacgatagaagcagacgcacatacactagctcatatgatgaactgcggtgctcgtatgacattc

SEQ ID NO: 421 - DNA, 5253 bp, Chlamydia trachomatis serovar D
atgaaatggctgtcagctactgcggtgtttgctgctgttctcccctcagtttcagggttttgcttcccagaacctaaagaattaaatttctctcgcgtaggaacttcttcctctaccacttttactgaaacagttggagaagctggggcagaatatatcgtctctggtaacgcatctttcacaaaatttaccaacattcctactaccgatacaacaactcccacgaactcaaactcctctagctctaacggagagactgcttccgtttctgaggatagtgactctacaacaacgactcctgatcctaaaggtggcggcgccttttataacgcgcactccggagttttatcctttatgacacgatcaggaacagaaggttccttaactctgtctgagataaaaataactggtgaaggcggtgctatcttctctcaaggagagctgctatttacagatctgacaggtctaaccatccaaaataacttatcccagctatccggaggagcgatttttggagaatctacaatctccctatcagggattactaaagcgactttctcctccaactctgcagaagttcctgctcctgttaagaaacctacagaacctaaagctcaaacagcaagcgaaacgtcgggttctagtagttctagcggaaatgattcggtgtcttcccccagttccagtagagctgaacccgcagcagctaatcttcaaagtcactttatttgtgctacagctactcctgctgctcaaaccgatacagaaacatcaactccctctcataagccaggatctgggggagctatctatgctaaaggcgaccttactatcgcagactctcaagaggtactattctcaataaataaagctactaaagatggaggagcgatctttgctgagaaagatgtttctttcgagaatattacatcattaaaagtacaaactaacggtgctgaagaaaagggaggagctatctatgctaaaggtgacctctcaattcaatcttctaaacagagtctttttaattctaactacagtaaacaaggtggtggggctctatatgttgaaggagatataaacttccaagatcttgaagaaattcgcattaagtacaataaagctggaacgttcgaaacaaaaaaaatcactttaccaaaagctcaagcatctgcaggaaatgcagatgcttgggcctcttcctctcctcaatctggttctggagcaactacagtctccaactcaggagactctagctctggctcagactcggatacctcagaaacagttccagccacagctaaaggcggtgggctttatactgataagaatctttcgattactaacatcacaggaattatcgaaattgcaaataacaaagcgacagatgttggaggtggtgcttacgtaaaaggaacccttacttgtgaaaactctcaccgtctacaatttttgaaaaactcttccgataaacaaggtggaggaatctacggagaagacaacatcaccctatctaatttgacagggaagactctattccaagagaatactgccaaagaagagggcggtggactcttcataaaaggtacagataaagctcttacaatgacaggactggatagtttctgtttaattaataacacatcagaaaaacatggtggtggagcctttgttaccaaagaaatctctcagacttacacctctgatgtggaaacaattccaggaatcacgcctgtacatggtgaaacagtcattactggcaataaatctacaggaggtaatggtggaggcgtgtgtacaaaacgtcttgccttatctaaccttcaaagcatttctatatccgggaattctgcagctgaaaatggtggtggagcccacacatgcccagatagcttcccaacggcggatactgcagaacagcccgcagcagcttctgccgcgacgtctactcccgagtctgccccagtggtctcaactgctctaagcacaccttcatcttctaccgtctcttcattaaccttactagcagcctcttcacaagcctctcctgcaacctctaataaggaaactcaagatcctaatgctgatacagacttattgatcgattatgtagttgatacgactatcagcaaaaacactgctaagaaaggcggtggaatctatgctaaaaaagccaagatgtcccgcatagaccaactgaatatctctgagaactccgctacagagataggtggaggtatctgctgtaaagaatctttagaactagatgccctagtctccttatctgtaacagagaaccttgttgggaaagaaggtggaggcttacatgctaaaactgtaaatatttctaatctgaaatcaggcttctctttctcgaacaacaaagcaaactcctcatccacaggagtcgcaacaacagcttcagcacctgctgcagctgctgcttccctacaagcagccgcagcagccgtaccatcatctccagcaacaccaacttattcaggtgtagtaggaggagctatctatggagaaaaggttacattctctcaatgtagcgggacttgtcagttctctgggaaccaagctatcgataacaatccctcccaatcatcgttgaacgtacaaggaggagccatctatgccaaaacctctttgtctattggatcttccgatgctggaacctcctatattttctcggggaacagtgtctccactgggaaatctcaaacaacagggcaaatagcgggaggagcgatctactcccctactgttacattgaattgtcctgcgacattctctaacaatacagcctctatggctacaccaaagacttcttctgaagatggatcctcaggaaattctattaaagataccattggaggagccattgcagggacagccattaccctatctggagtctctcgattttcagggaatacggctgatttaggagctgcaataggaactctagctaatgcaaatacacccagtgcaactagcggatctcaaaatagcattacagaaaaaattactttagaaaacggttcttttatttttgaaagaaaccaagctaataaacgtggagcgatttactctcctagcgtttccattaaagggaataatattaccttcaatcaaaatacatccactcatgatggaagtgctatctactttacaaaagatgctacgattgagtctttaggatctgttctttttacaggaaataacgttacagctacacaagctagttctgcaacatctggacaaaatacaaatactgccaactatggggcagccatctttggagatccaggaaccactcaatcgtctcaaacagatgccattttaacccttcttgcttcttctggaaacattacttttagcaacaacagtttacagaataaccaaggtgatactcccgctagcaagttttgtagtattgcaggatacgtcaaactctctctacaagccgctaaagggaagactattagctttttcgattgtgtgcacacctctaccaaaaaaataggttcaacacaaaacgtttatgaaactttagatattaataaagaagagaacagtaatccatatacaggaactattgtgttctcttctgaattacatgaaaacaaatcttacatcccacagaatgcaatccttcacaacggaactttagttcttaaagagaaaacagaactccacgtagtctcttttgagcagaaagaagggtctaaattaattatgaaacccggagctgtgttatctaaccaaaacatagctaacggagctctagttatcaatgggttaacgattgatctttccagtatggggactcctcaagcaggggaaatcttctctcctccagaattacgtatcgttgccacgacctctagtgcatccggaggaagcggggtcagcagtagtataccaacaaatcctaaaaggatttctgcagcagcgccttcaggttctgccgcaactactccaactatgagcgagaacaaagttttcctaacaggagaccttactttaatagatcctaatggaaacttttaccaaaaccctatgttaggaagcgatctagatgtaccactaattaagcttccgactaacacaagtgacgtccaagtctatgatttaactttatctggggatcttttccctcagaaagggtacatgggaacctggacattagattctaatccacaaacagggaaacttcaagccagatggacattcgatacctatcgtcgctgggtatacatacctagggataatcatttttatgcgaactctatcttaggctcccaaaactcaatgattgttgtgaagcaagggcttatcaacaacatgttgaataatgcccgcttcgatgatatcgcttacaataacttctgggtttcaggagtaggaactttcttagctcaacaaggaactcctctttccgaagaattcagttactacagccgcggaacttcagttgccatcgatgccaaacctagacaagattttatcctaggagctgcatttagtaagatggtggggaaaaccaaagccatcaaaaaaatgcataattacttccataagggctctgagtactcttaccaagcttctgtctatggaggtaaattcctgtatttcttgctcaataagcaacatggttgggcacttcctttcctaatacaaggagtcgtgtcctatggacatattaaacatgatacaacaacactttacccttctatccatgaaagaaataaaggagattgggaagatttaggatggttagcggatcttcgtatctctatggatcttaaagaaccttctaaagattcttctaaacggatcactgtctatggggaacttgagtattccagcattcgccagaaacagttcacagaaatcgattacgatccaagacacttcgatgattgtgcttacagaaatctgtcgcttcctgtgggatgcgctgtcgaaggagctatcatgaactgtaatattcttatgtataataagcttgcattagcctacatgccttctatctacagaaataatcctgtctgtaaatatcgggtattgtcttcgaatgaagctggtcaagttatctgcggagtgccaactagaacctctgctagagcagaatacagtactcaactatatcttggtcccttctggactctctacggaaactatactatcgatgtaggcatgtatacgctatcgcaaatgactagctgcggtgctcgcatgatcttc

SEQ ID NO: 422 - DNA, 1980 bp, Chlamydia trachomatis serovar D
atgagcgaaaaaagaaagtctaacaaaattattggtatcgacctagggacgaccaactcttgcgtctctgttatggaaggtggccaacctaaagttattgcctcttctgaaggaactcgtactactccttctatcgttgcttttaaaggtggcgaaactcttgttggaattcctgcaaaacgtcaggcagtaaccaatcctgaaaaaacattggcttctactaagcgattcatcggtagaaaattctctgaagtcgaatctgaaattaaaacagtcccctacaaagttgctcctaactcgaaaggagatgcggtctttgatgtggaacaaaaactgtacactccagaagaaatcggcgctcagatcctcatgaagatgaaggaaactgctgaggcttatctcggagaaacagtaacggaagcagtcattaccgtaccagcttactttaacgattctcaaagagcttctacaaaagatgctggacgtatcgcaggattagatgttaaacgcattattcctgaaccaacagcggccgctcttgcttatggtattgataaggaaggagataaaaaaatcgccgtcttcgacttaggaggaggaactttcgatatttctatcttggaaatcggtgacggagtttttgaagttctctcaaccaacggggatactcacttgggaggagacgacttcgatggagtcatcatcaactggatgcttgatgaattcaaaaaacaagaaggcattgatctaagcaaagataacatggctttgcaaagattgaaagatgctgctgaaaaagcaaaaatagaattgtctggtgtatcgtctactgaaatcaatcagccattcatcactatcgacgctaatggacctaaacatttggctttaactctaactcgcgctcaattcgaacacctagcttcctctctcattgagcgaaccaaacaaccttgtgctcaggctttaaaagatgctaaattgtccgcttctgacattgatgatgttcttctagttggcggaatgtccagaatgcctgcggtacaagcagttgtaaaagagatctttggtaaagagcctaataaaggcgtcaatccagatgaagttgtagcgattggagctgctattcagggtggtgtcctcggcggagaagtgaaagacgttctgttgttggatgtgattcccctctctttaggaattgagactctaggtggggtcatgactcctttggtagagagaaacactacaatccctactcagaagaagcaaatcttctctacagccgctgacaatcagccagcagtgactatcgtcgttcttcaaggtgaacggcctatggcgaaagacaataaggaaattggaagatttgatctaacagacattcctcctgctcctcgcggccatccacaaattgaggtaaccttcgatattgatgccaacggaattttacacgtttctgctaaagatgctgctagtggacgcgaacaaaaaatccgtattgaagcaagctctggattaaaagaagatgaaattcaacaaatgatccgcgatgcagagcttcataaagaggaagacaaacaacgaaaagaagcttctgatgtgaaaaatgaagccgatggaatgatctttagagccgaaaaagctgtgaaagattaccacgacaaaattcctgcagaacttgttaaagaaattgaagagcatattgagaaagtacgccaagcaatcaaagaagatgcttccacaacagctatcaaagcagcttctgatgagttgagtactcatatgcaaaaaatcggagaagctatgcaggctcaatccgcatccgcagcagcatcttctgcagcgaatgctcaaggagggccaaacattaactccgaagatctgaaaaaacatagtttcagcacacgacctccagcaggaggaagcgcctcttctacagacaacattgaagatgctgatgttgaaattgttgataaacctgag

SEQ ID NO: 423 - DNA, 978 bp, Chlamydia trachomatis serovar D
atggtttctcaaacagtgagtgtagcagtaacaggaggaacagggcaaatagcctatagctttctattttctctggctcatggagatgtttttggccttgattgtggcatcgatctgcgtatctacgatattcctggaacagaaagggctttatctggtgtgcgcatggagctagatgatggtgctttccctttattacagcgtgtgcaggtaacgacatcattgcatgatgcttttgatggcattgatgcggcattccttatagggtcagttcctagaggcccaggaatggagagaagagatcttctaaagaaaaatggggagatttttgctacgcaaggaaaagctttgaacacaacagccaagcgggatgcaaagatttttgttgttgggaaccctgtgaataccaattgctggatagcaatgaatcatgctcccagattattgagaaagaactttcatgcgatgctacgattggaccagaatcgtatgcatagcatgttatcgcatagagcagaagtacctttatcggctgtatcacaagttgtggtttggggaaatcactccgccaaacaagtgcctgattttacgcaagctctgattaatgaccgtcctatcgcagagacgatagcggatcgtgattggttagagaatattatggtgccttctgtacagagtcgtggtagtgcagtaatcgaagcacgagggaagtcttcggcagcttctgcagcacgagctttagcagaggctgctcgatcaatatatcagccaaaagaaggagaatggttttcttccggagtgtgttcggaccacaatccctatggattaccggaagatttaatctttggtttcccttgtcgaatgctagcaacgggagaatatgaagtgattccaaggcttccttgggatgcctttatccgtgggaaaatgcaaatatctcttgatgagattcttcaggaaaaagctagcgtatctttg

SEQ ID NO: 424 - DNA, 696 bp, Chlamydia trachomatis serovar D
atgacaaagcatggaaaacgcattcgtggtatccaagagacttacgatttagctaagtcgtattctttgggtgaagcgatagatattttaaaacagtgtcctactgtgcgtttcgatcaaacggttgatgtgtctgttaaattagggatcgatccaagaaagagtgatcagcaaattcgtggttcggtttctttacctcacggtacaggtaaagttttgcgaattttagtttttgctgctggagataaggctgcagaggctattgaagcaggagcggactttgttggtagcgacgacttagtagagaaaatcaaaggtggatgggttgacttcgatgttgcggttgccactcccgatatgatgagagaggtcggaaagctaggaaaagttttgggtccaagaaaccttatgcctacgcctaaagccggaactgtaacaacagatgtggttaaaactgttgcggaactgcgaaaaggtaaaattgaatttaaagctgatcgagctggtgtatgcaacgtcggagttgcgaagctttctttcgatagtgcgcaaatcaaagaaaatgtcgaagcgttgtgtgcagccttagttaaagctaaacccgcaactgctaaaggacaatatttagttaatttcactatttcctcgaccatggggccaggggttaccgtggatactagggagttgattgcgtta

SEQ ID NO: 425 - DNA, 3756 bp, Chlamydia trachomatis serovar D
atgttcaagtgcccggagcgggtcagcatcaaaaagaaagaagatattttagatcttcctaatcttgtcgaagttcaaatcaagtcgtataagcagtttcttcaaatcgggaagcttgctgaagagcgagaaaacattggtttagaagaagtcttcagagaaattttccctatcaagtcttataatgaagctacgattttagagtacctctcttataacttaggagtgcccaaatactccccagaagagtgtattcgtcggggaatcacctatagtgttactttaaaggttcgtttccgtttaactgatgaaacggggattaaagaagaagaagtctatatgggaaccatccccatcatgactgataagggaacctttattattaatggggcagagagagtcgttgtttctcaagtccaccgttctccaggaatcaattttgaacaagaaaaacattctaaaggaaatgttttattttcttttagaattattccttatcgaggaagttggttagaagctgtcttcgacattaatgaccttatctatatccatattgataggaaaaaacgtcgcagaaagattttagctatgacgtttatccgagctttaggatattcaacagatgcagatattattgaagagttcttttctgtagaggagcgttccttacgtttagagaaggattttgtcgcgttagttggtaaagttttagctgataacgtagttgatgcggattcttcattagtttacgggaaagctggagagaagctaagtactgctatgctaaaacgcatcttagatgcgggagtccaatctttgaagattgctgttggcgcagatgaaaatcacccaattattaagatgctcgcaaaagatcctacggattcttacgaagctgctcttaaagatttttatcgcagattacgaccaggagagcctgcaactttagttaatgctcgatccacaattatgcgcttattcttcgatgctaaacgctataatttaggccgcgttggacgttataaattaaataaaaaattaggattcccattagacgacgaaacattatctcaagtgactttgagaaaagaagatgttatcggcgcgttgaaatatttgattcgtttgcgaatgggcgatgagaagacatctatcgatgatattgaccatttggcaaaccgacgagttcgctctgttggagaactaattcagaatcactgtcgttctggattggctagaatggaaaagatcgttcgagaaagaatgaatctctttgatttctcttctgataccctaactccaggaaagattatttctgctaaagggttagtcagtgtcctgaaagatttcttcagccgttctcaattatctcagtttatggatcagacaaaccctgtcgcagaattgacgcacaagcgtcgtctgtcagcattaggacctgggggattgaatagagaaagagctgggtttgaagttcgagacgttcacgcaagccactatggtagaatttgtccaattgagactcctgaaggaccaaacattgggttgattacttcactgtcttcctttgctaagatcaatgaatttggattcatagagactccttatcgtgtcgtgcgcgatggcatcgtgacagatgaaattgagtatatgacagcagatgttgaagaagagtgtgtcattgctcaggcttctgcggagctcgatgagtatgatatgtttaaaactcccgtatgctgggctagatacaaaggagaggcttttgaagccgacacaagtacggttacgcatatggacgtttctccaaaacagctggtatctgtggttacggggctgattcctttcttggaacacgacgatgctaaccgagctcttatgggatcgaacatgcaacggcaggctgtaccattattgaaaacggaagctgctattgttggaactggattagaagggcgtgctgccaaagattctggagctattattgtggctcaggaagatggggtagtcgaatacgtagatagctatgagattgtcgtagcgaagaagaataatccaacgcttaaggatcgttatcagcttaaaaaattcttaagatccaactccggaacatgcatcaaccaaactcctttgtgttctgtgggagatgtggttacgcatggagatgttttagcggatggcccagcaaccgataaaggggaattggctcttggtaaaaacgtattagtagccttcatgccttggtacgggtataacttcgaagatgcgattatcatctccgagaggttgattaaacaagatgcgtacacttctatttacatagaagaatttgagttaacagctcgagatacaaaactcggtaaagaagaaattactagagatattcctaacgtttctgaagaggttttggcaaatctcggagaggatggtgtcgtccgtattggggctgaagtcaagccgggagatattcttgtcggtaaaatcactccgaaatctgagacggaactagctcctgaagagcgtttgttgcgagctatttttggagagaaggcggcggacgtaaaagatgcctctctaacggttcctcctggtacagaaggagtcgtaatggatgtcaaagtattcagcagaaaggatcgcttgtccaagagcgatgatgaactggttgaagaagctgtgcatcttaaggatctacagaaagaatataagagtcagttagctcaattgaaagtagaacatagagagaaactgggggctctattgctcaatgaaaaagctcctgcagcgattatacaccgtcgttcggcagatattttggttcaagaaggtgctatttttgatcaagagactatcgaactcttagaaagagagtcgctagttgatttgctgatggctccttgtgacatgtatgatgttttgaaagatattctttctagctatgaaacagctgttcagcgtttggaagtcaattataaaaccgaagctgagcacataaaagaaggtgatgctgacttagatcatggagttatccgacaagttaaagtttacgtggcttccaagcgaaaacttcaagttggggataaaatggctggacgtcacggaaacaagggagtggtttccaagattgttccagaagcagacatgcctttcttagctaacggtgaaacagtacagatgattttgaacccgttaggggtgccttctcgaatgaaccttggacaggttttagagacacatttaggatatgctgcaaaaactgcaggtatctatgtgaaaactccggtctttgaagggttcccagagtctcgtatttgggatatgatgatagagcagggattgcccgaagatggtaagtcttacctatttgatggtaaaaccggagagcgtttcgatagcaaagtggtcgttggatacatctacatgttgaaattgagtcacttaattgctgataagatccacgctcgttctataggaccttactctctcgttacgcagcaacctcttggaggtaaagcgcagatgggaggacagagattcggggaaatggaggtatgggctttagaggcgtatggggtagctcatatgttacaagagattctgactgttaagtccgacgatgtttcgggaagaactcgtatctacgaatcaatcgtgaaaggagaaaacttacttcgttctggaacgcctgagtcgttcaacgttttgattaaagaaatgcaaggtctagggcttgatgttcgccctatggtagtagatgct

SEQ ID NO: 426 - DNA, 894 bp, Chlamydia trachomatis serovar D
atgttgaaaattgatttaacaggaaaaattgctttcatagccggcataggcgatgataacgggtatggctggggcattgccaaaatgttagcagaagcaggcgcaaccatacttgtggggacctgggttcctatctataaaattttctctcaatctttggagttaggaaaattcaatgcatctcgtgaactctccaatggagaattgctaactttcgctaaaatctatcccatggatgccagtttcgacaccccagaagatattcctcaggaaattttggaaaataaacgttacaaagatctttctgggtacactgtatccgaagttgtagaacaggtgaaaaaacattttggacacattgatattcttgttcactctttagcaaacagtccggaaattgctaaaccattacttgatacctctcgtaaaggctatcttgccgccttaagtacatccagctactcctttatcagccttctctctcattttggcccaattatgaatgcaggagctagcaccatctctctaacttatcttgcttccatgcgtgctgttccagggtatggcggaggaatgaacgcagcaaaagctgctttagaaagtgatacaaaagtactggcttgggaagccggccgacgttggggagtccgagtgaatactatctcggcagggccattagctagccgtgcaggaaaagctattggatttattgagagaatggtggattactaccaagactgggctccactaccttctccaatggaagctgagcaagtaggcgcagcagcagccttcttagtctctcccctagctagcgcaattacgggagaaactctctatgtggatcacggagccaatgtgatgggcataggtccagaaatgtttcctaaggat

SEQ ID NO: 427 - DNA, 894 bp, Chlamydia trachomatis serovar D
atgagtttacagaagttattagttacagacattgacgggacaattacacatcaatcccacctacttcatgatcgtgttgtaaaggctttgcatcaatactatgattctggttggcagttattttttctaactggcagatatttttcttatgcatatcctctttttcaaaacttttcggttccttttctattaggtagccagaatggttcttccgtgtggtcctccacggataaagagtttatttattttcgtagcttgtctcgagattttctatatgttttagagaaatattttgaagatttagatctcattgcctgtatagaatctggagcctctaatcgtgatgtatactttcgaaagggattagggaaaacatctcaggaactcaaagcgattcttgatgctgtgtattttcctacaccagaagctgcgcgactgctggtggatgttcagggacatttatcagaagaattttcttatgaagattttgccattgccaaatttttcggtgagagagaggaagtgaagaaaattatggatagatttattcaatctccagaagtttcttcacaggtaaccatgaattacatgcgttggccttttgatttcaaatacgcagtgcttttacttactttaaaagatgtttcaaaaggttttgctgtagatcaagttgttcagaccttctataaagagaataagccttttattatggcttctggggatgatgctaacgatatcgacctgctatctcgaggagattttaaaattgttatacagacggctccagaggagatgcatggattagcggactttttggctcccccggcgaaggattttggtattctctccgcctgggaagctggtgagctgcgttacaaacagctagttaatcct

SEQ ID NO: 428 - DNA, 459 bp, Chlamydia trachomatis serovar D
atgttgcgcttgtttcaacatatattgtgttttttagaagaagacccttcgtttgtagacgtccctcaagagctttcttttgtcaatgaagctttctctggttctatgcgttgggaagtaggtaggatgctaggctctttacttctcctgttagggatatttggaggggggtgtttgctatttcgacgttttttgcgttcccgcggacatcttcctagcggcaattcgtccattaagattttggatcaacgggttttggcttcaaaaacctccatctatgtgattaaagtagcgaacaagactttagttgttgctgagagaggagagcgagtgaccttattatctgaatttcctccgaatacagatcttaatgagctaatacagaaggatcaaaaaaaaccttcgactcctcgaggggagatgctttcaggtttcttaaagcaatttaaagaaaagaaa

SEQ ID NO: 429 - DNA, 1707 bp, Chlamydia trachomatis serovar D
atgccaaaacaagctgattatacttggggagcaaaaaagaatctcgatacgatagcttgcttaccagaagacgttaaacaatttaaagaccttctctacgcgatgtatggcttcaccgcgacagaagaagaacccactagcgaagtacatcctggtgcgatcctaaaaggtacagttgttgacataagcaaagactttgttgttgtagatgtcggcttaaaatctgagggagttattcctatgtctgagtttatcgactcttcagaaggtttaactgtcggagccgaagtcgaagtttacctagaccaaactgaggatgacgaaggaaaagttgttttatccagagaaaaagcaacaagacaacgacaatgggaatacattcttgctcactgcgaggaaggttctattgttaagggacaaattacccgaaaagttaagggtggtttgatcgtagatattggtatggaagccttccttccaggatcccaaatagacaataagaagatcaagaacttagatgattacgtaggcaaggtttgtgagttcaaaattctcaaaatcaacgtagatcgtcggaacgttgttgtatctagaagagaacttctcgaagctgaacgcatttctaagaaagcagagttgatcgagcaaatcactatcggtgagcgtcgcaaaggtatcgttaagaatatcacagatttcggagtattcttggatcttgatggcattgacggcctactccacattacagacatgacatggaaacgcattcgtcacccatccgaaatggttgaactcaaccaagaattggaagtcatcatccttagcgttgataaagaaaaaggtcgcgtagctcttggcctcaaacaaaaagagcataatccttgggaagatattgagaagaaatatcctccaggaaaacgtgttcgcggaaaaattgttaaactccttccttatggagcatttattgaaatcgaagaaggaattgaaggccttattcacgtttcagagatgtcttgggttaagaacattgtagatcctaatgaagtggtcaacaaaggtgatgaagtcgaagtagttgttctttctatccaaaaagatgaaggaaaaatctctctcggtctcaaacaaacaaaacacaatccttgggataacattgaagaaaaatatcctatcggcctccgcgtaacagcagaaattaaaaatctgacaaactacggagctttcgttgagttggagccaggaatcgaaggtttgatccatatctctgacatgagttggattaaaaaagtttcccatccttcagagctcttcaaaaaaggtaataccgtcgaagcagttattctgtctgtagacaaagaaagcaaaaaaatcactttgggcgtgaaacaattaactcctaatccatgggatgagattgaagttatgttccctgtcggaagtgatatctctggcgtagtaactaaaattacggctttcggagctttcgttgagttgcaaaatggtatcgaaggactgatccatgtatccgagctttcagagaaaccttttgctaaaattgaagatgttctctctattggagacaaagtttctgctaaagttatcaagctagacccagatcacaagaaagtttctctttctattaaagagttccttgttcatgggggagatgctggtcacgatgcggaagaagaatcttctgacagagac

SEQ ID NO: 430 - DNA, 1998 bp, Chlamydia trachomatis serovar D
atggaatctttgtctgttcgttccactatccctttacctctaggagccaaaaagctctccgctgatcgctaccgtttttctctattttcttcacaagcccagcaggttactcttgtactattagaccctctttctgaaattcatgaaattcctctatcttctaccgaccacaggactggagccatctggcatatcgaaattgcaggcatttctagtgaatggtcgtatgcttataaactacgtggtacagacttgagctctcaaaagtttgctacagattcttacatcgcagacccttattctaagaatatctactcccctcaactatttggatcccctaaacaagaaaaggattacgcatttagttacctgaaacatgaggattttgactgggaaggcgacactcctttgcaccttccaaaagaaaattacttcatttatgaaatgcatgttcggtcattcacccgagatccgtcttcccaggtttcccatcctggaactttccttggtattatcgaaaaaatagaccacctcaaacaactaggcgttcatgcagttgaactccttcctattttcgaattcgatgaaaccgtccatccatttaaaaatcaggacttcccccacctgtgtaactattgggggtattcttcggtgaattttttctgcccctctcgccgttatacttatggggcagacccttgcgctccggcccgagagttcaagactcttgtcaaagcattacaccgtgcgggaatcgaagtcattctcgatgtcgttttcaatcatacaggctttgaaggcacaagctgccctcttccctggatagatctagaatcctattatatggtcaatgatcatggggatctcatgaatttctccgggtgtggtaatacagtcaataccaacacccccactactctgaaatggattcttgatgctttgcggtactgggtacaggaaatgcacgtagatggatttcgttttgatttagcctcagtcttctctagagatccacaaggagtccctctccctttaacccccattttgcaagctatatcctctgattccattttatcagaaactaaactgatcgctgaaccttgggacgctggaggtttgtatcagcttggacacttcccctctatatcaacccgatggagcgagtggaatggatgctaccgtgaccatgtaaaagccttcctgaatggagatgctcatcaagtaagttcctttgcttcacgaatatctggatctcatgacatctatcccaatgggaaacctacgaactcgattaactatatctgctctcatgatggcttcacactctacgatactgttgcctataacgataagcacaatgaagagaatggtgaatacaatcgtgatgggacttcagcaaactatagctataactttggctgcgaaggagaaacgacagatcccaccatttgcgctctacgtgaacgccaaatgaaaaacttctttcttgctctctttttatctcaaggaattcccatgatacaatccggagatgaatatgggcacacagcttatggaaataataatcactggtgcttagacacaaagatcaattactttctttgggatcgattagctgaaaggaaagaactgttttctttcttatgccaagtcattgctctgcgcaaagcttataccgaattattcaatacctctttcttatcagaagatacgattacctggctaaatacaaaaggttctcccagagagtggggagccgatcattatctagcttttgagttgaaacacctgaactacagtttattcgtagcgttttatagtgggaatgaacgtattgagatctctttacctaaacctagaaaagaacatttggcctatgaaaaaattgtagatagcacaacaggattcttttctcagatattatctcccaaactctctcttgaaccttatagctctttggtagccatcagcagaagaaaaacctccttggaatctaga

SEQ ID NO: 431 - protein, 609 aa, Chlamydia trachomatis serovar D
MGFWRTSIMKMNRIWLLLLTFSSAIHSPVQGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSF

SEQ ID NO: 432 - protein, 268 aa, Chlamydia trachomatis serovar D
MPPRSPSFLVHIWRLFFAKGPNYSLPYAFLCIFVSVLVFLPIGLWLTLPSFLNFKHSLTPIKTLFLTCTEPPCLPEPFFSDILHLSADSPPALQTFSTKSAEHFLNELGVFSFISIEKVPDHKGLAISYALHTPLAFLGNQTHTFIGYEGQTFPALPFFQSLELPTVFFSQQALSQTRIPHQTLSIVTSLIDQLQMDPPSIIDLSQIDHYPGEFVVSLSSGTLLRFRKDSFLPGIQHYQQALSLGAFSPQQAVICDLRCEDYLLLKRK

SEQ ID NO: 433 - protein, 221 aa, Chlamydia trachomatis serovar D
MKKFIYKYSFGALLLLSGLSGLSSCCANSYGSTLAKNTAEIKEESVTLREKPDAGCKKKSSCYLRKFFSRKKPKEKTEPVLPNFKSYADPMTDSERKDLSFVVSAAADKSSIALAMAQGEIKGALSRIREIHPLALLQALAEDPALIAGMKKMQGRDWVWNIFITELSKVFSQAASLGAFSVADVAAFASTLGLDSGTVTSIVDGERWAELIDVVIQNPAI

SEQ ID NO: 434 - protein, 490 aa, Chlamydia trachomatis serovar D
MSDLSDLFKTHFTQYASYVILERAIPHVLDGLKPVQRRLLWTLFRMDDGKMHKVANIAGRTMALHPHGDAPIVEALVVLANKGFLIETQGNFGNPLTGDPHAAARYIEARLSPLAKEVLFNTDLMTFHDSYDGREQEPDILAAKIPLLLLHGVDGIAVGMTTKIFPHNFCDLLEAQIAILNDQPFSLLPDFPPGGTMDASDYQDGLGSIVLRATIDIINDKTLLIKEICPSTTTETLIRSIENAAKRGIIKIDSIQDFSTDLPHIEIKLPKGIYAKDLLRPLYTHTECQVILTSRPTAIYQGKPWETTISEILRLQTKTLQNYLKKELLILEDSLSRELYHKTLEYLFIKHKLYDTVRSMLSKRKTSPSSSTIHNAVLEALTPFLDTLPAPDKQATAQLAALTIKKILCFDENSYEKELACLEKKRSSVQKDLSQLKKYTVLYIKKLLETYRQLGHRKTKIAKFDDLPTERVSAHKKAKELAALDQEENF

SEQ ID NO: 435 - protein, 78 aa, Chlamydia trachomatis serovar D
MKEFLAYIVKNLVDKPEEVHLKEVQGTNTIIYELTVAKGDIGKIIGKEGRTIKAIRTLLVSVASRDNVKVSLEIMEER

SEQ ID NO: 436 - protein, 647 aa, Chlamydia trachomatis serovar D
MESGPESVSSNQSSMNPIINGQIASNSETKESTKESEASPSASSSVSSWSFLSSAKHALISLRDAILNKNSSPTDSLSQLEASTSTSTVTRVAARDYNEAKSNFDTAKSGLENATTLAEYETKMADLMAALQDMERLAKQKAEVTRIKEALQEKQEVIDKLNQLVKLEKQNQTLKETLTTTDSADQIPAINSQLEINKNSADQIIKDLEGQNISYEAVLTNAGEVIKASSEAGIKLGQALQSIVDAGDQSQAAVLQAQQNNSPDNIAATKKLIDAAETKVNELKQEHTGLTDSPLVKKAEEQISQAQKDIQEIKPSGSDIPIVGPSGSAASAGSAVGALKSSNNSGRISLLLDDVDNEMAAIAMQGFRSMIEQFNVNNPATAKELQAMEAQLTAMSDQLVGADGELPAEIQAIKDALAQALKQPSTDGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQVNQEEIMQKLTASISKAPQFGYPAVQNSADSLQKFAAQLEREFVDGERSLAESRENAFRKQPAFIQQVLVNIASLFSGYLS

SEQ ID NO: 437 - protein, 231 aa, Chlamydia trachomatis serovar D
MMEVFMNFLDQLDLIIQNKHMLEHTFYVKWSKGELTKEQLQAYAKDYYLHIKAFPKYLSAIHSRCDDLEARKLLLDNLMDEENGYPNHIDLWKQFVFALGVTPEELEAHEPSEAAKAKVATFMRWCTGDSLAAGVAALYSYESQIPRIAREKIRGLTEYFGFSNPEDYAYFTEHEEADVRHAREEKALIEMLLKDDADKVLEASQEVTQSLYGFLDSFLDPGTCCSCHQSY

SEQ ID NO: 438 - protein, 533 aa, Chlamydia trachomatis serovar D
MSNSFRDQEQGLQAVFRAARVISHMFSQTIGPYGFSTIVHNVQDTRTTQDSQSMLKDILFPDVFENIGMKLIRDTALRTRMRFGDGAKTTALLIEALLAEGMTGIQKGLDPHEIHRGMLLAEKKIQEVFYRETFPLSDLEHTVYVSSIARRCNSEIASVLSSAVGYGGKNGYYIVEEHEEHETYWHAEEHAVWDFGYASPYFITHAETGTVEYSQVYILVSEQPLHYSNPSFLTFLQSVVQAGKTPLVILAEAFDKELLAMLEMNQIERVFPVCAVKVSGKHARESLEDIAVLTGATLLSEMDFEDSEEERITNRLGFVAGICVSSTSLCVPRETDNKQRMAEHCAFLQDKLSFSQEEEASARLRRRLARLSSGEVCIHIAADCIPQEEIGYITSSIRAMTESLRSGCLPGGGCAFIRAAREISVPLALSPSERFGFLAVLSAAEKPFRAIVTRSRRVEEEVFSEVFSQADWRVGFNGVSGFVEDIVSQGICDGASCIQYALSHAVGTTGLLLTSALFIASQEPMLREENSEE

SEQ ID NO: 439 - protein, 465 aa, Chlamydia trachomatis serovar D
MNEAFDCVVIGAGPGGYVAAITAAQAGLKTALIEKREAGGTCLNRGCIPSKALLAGAEVVTQIRHADQFGIHVEGFSINYPAMVQRKDSVVRSIRDGLNGLIRSNKITVFSGRGSLISSTEVKILGENPSVIKAHSIILATGSEPRAFPGIPFSAESPRILCSTGVLNLKEIPQKMAIIGGGVIGCEFASLFHTLGSEVSVIEASSQILALNNPDISKTMFDKFTRQGLRFVLEASVSNIEDIGDRVRLTINGNVEEYDYVLVSIGRRLNTENIGLDKAGVICDERGVIPTDATMRTNVPNIYAIGDITGKWQLAHVASHQGIIAARNIAGHKEEIDYSAVPSVIFTFPEVASVGLSPTAAQQQKIPVKVTKFPFRAIGKAVAMGEADGFAAIISHETTQQILGAYVIGPHASSLISEITLAVRNELTLPCIYETIHAHPTLAEVWAESALLAVDTPLHMPPAKK

SEQ ID NO: 440 - protein, 122 aa, Chlamydia trachomatis serovar D
MPRIIGIDIPAKKKLKISLTYIYGIGPALSKEIIARLQLNPEARAAELTEEEVGRLNALLQSDYVVEGDLRRRVQSDIKRLITIHAYRGQRHRLSLPVRGQRTKTNSRTRKGKRKTVAGKKK

SEQ ID NO: 441 - protein, 553 aa, Chlamydia trachomatis serovar D
MRIGDPMNKLIRRAVTIFAVTSVASLFASGVLETSMAESLSTNVISLADTKAKDNTSHKSKKARKNHSKETPVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINIVNQGTATARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 442 - protein, 192 aa, Chlamydia trachomatis serovar D
MPEGEMMHKLQDVIDRKLLDSRRIFFSEPVTEKSATEAIKKLWYLELTNPGQPIVFVINSPGGSVDAGFAVWDQIKMISSPLTTVVTGLAASMGSVLSLCAVPGRRFATPHARIMIHQPSIGGTITGQATDLDIHAREILKTKARIIDVYVEATGQSREVIEKAIDRDMWMSANEAMEFGLLDGILFSFNDL

SEQ ID NO: 443 - protein, 275 aa, Chlamydia trachomatis serovar D
MGFSSLLTTCRYLLYSGAGNSFILGESMPSLEDVLFLCQEEMVDGFLCVESSEIADAKLTVFNSDGSIASMCGNGLRCAMAHVAQCFGLEDVSIETERGVYQGKFFSMNRVLVDMTLPDWKKAERKLTHVLPGMPEQVFFIDTGVPHVVVFVSDLSKVPVQEWGSFLRYHEDFAPEGVNVDFVQRKKDDLLLVYTYERGCERETLSCGTGMLASALVAADIFSLGQDFSIAVCSRSRNLIKIFSEKGKVFLEGPVSLLNRSENFGWLEPKSRRFG

SEQ ID NO: 444 - protein, 1770 aa, Chlamydia trachomatis serovar D
MKFMSATAVFAAALSSVTEASSIQDQIKNTDCNVSKLGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLIGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESEEQLQDSTQSNEENTLPNSNIDQSNENTDESSDSHTEEITDESVSSSSESGSSTPQDGGAASSGAPSGDQSISANACLAKSYAASTDSSPVSNSSGSEEPVTSSSDSDVTASSDNPDSSSSGDSAGDSEEPTEPEAGSTTETLTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNTTDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTGGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMLMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMLSIYRNSPTCKYQVLSSGEGGEIICGVPTRNSARGEYSTQLYLGPLWTLYGSYTIEADAHTLAHMMNCGARMTF

SEQ ID NO: 445 - protein, 1751 aa, Chlamydia trachomatis serovar D
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKITGEGGAIFSQGELLFTDLTGLTIQNNLSQLSGGAIFGESTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPESAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTENLVGKEGGGLHAKTVNISNLKSGFSFSNNKANSSSTGVATTASAPAAAAASLQAAAAAVPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKIGSTQNVYETLDINKEENSNPYTGTIVFSSELHENKSYIPQNAILHNGTLVLKEKTELHVVSFEQKEGSKLIMKPGAVLSNQNIANGALVINGLTIDLSSMGTPQAGEIFSPPELRIVATTSSASGGSGVSSSIPTNPKRISAAAPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 446 - protein, 660 aa, Chlamydia trachomatis serovar D
MSEKRKSNKIIGIDLGTTNSCVSVMEGGQPKVIASSEGTRTTPSIVAFKGGETLVGIPAKRQAVTNPEKTLASTKRFIGRKFSEVESEIKTVPYKVAPNSKGDAVFDVEQKLYTPEEIGAQILMKMKETAEAYLGETVTEAVITVPAYFNDSQRASTKDAGRIAGLDVKRIIPEPTAAALAYGIDKEGDKKIAVFDLGGGTFDISILEIGDGVFEVLSTNGDTHLGGDDFDGVIINWMLDEFKKQEGIDLSKDNMALQRLKDAAEKAKIELSGVSSTEINQPFITIDANGPKHLALTLTRAQFEHLASSLIERTKQPCAQALKDAKLSASDIDDVLLVGGMSRMPAVQAVVKEIFGKEPNKGVNPDEVVAIGAAIQGGVLGGEVKDVLLLDVIPLSLGIETLGGVMTPLVERNTTIPTQKKQIFSTAADNQPAVTIVVLQGERPMAKDNKEIGRFDLTDIPPAPRGHPQIEVTFDIDANGILHVSAKDAASGREQKIRIEASSGLKEDEIQQMIRDAELHKEEDKQRKEASDVKNEADGMIFRAEKAVKDYHDKIPAELVKEIEEHIEKVRQAIKEDASTTAIKAASDELSTHMQKIGEAMQAQSASAAASSAANAQGGPNINSEDLKKHSFSTRPPAGGSASSTDNIEDADVEIVDKPE

SEQ ID NO: 447 - protein, 326 aa, Chlamydia trachomatis serovar D
MVSQTVSVAVTGGTGQIAYSFLFSLAHGDVFGLDCGIDLRIYDIPGTERALSGVRMELDDGAFPLLQRVQVTTSLHDAFDGIDAAFLIGSVPRGPGMERRDLLKKNGEIFATQGKALNTTAKRDAKIFVVGNPVNTNCWIAMNHAPRLLRKNFHAMLRLDQNRMHSMLSHRAEVPLSAVSQVVVWGNHSAKQVPDFTQALINDRPIAETIADRDWLENIMVPSVQSRGSAVIEARGKSSAASAARALAEAARSIYQPKEGEWFSSGVCSDHNPYGLPEDLIFGFPCRMLATGEYEVIPRLPWDAFIRGKMQISLDEILQEKASVSL

SEQ ID NO: 448 - protein, 232 aa, Chlamydia trachomatis serovar D
MTKHGKRIRGIQETYDLAKSYSLGEAIDILKQCPTVRFDQTVDVSVKLGIDPRKSDQQIRGSVSLPHGTGKVLRILVFAAGDKAAEAIEAGADFVGSDDLVEKIKGGWVDFDVAVATPDMMREVGKLGKVLGPRNLMPTPKAGTVTTDVVKTVAELRKGKIEFKADRAGVCNVGVAKLSFDSAQIKENVEALCAALVKAKPATAKGQYLVNFTISSTMGPGVTVDTRELIAL

SEQ ID NO: 449 - protein, 1252 aa, Chlamydia trachomatis serovar D
MFKCPERVSIKKKEDILDLPNLVEVQIKSYKQFLQIGKLAEERENIGLEEVFREIFPIKSYNEATILEYLSYNLGVPKYSPEECIRRGITYSVTLKVRFRLTDETGIKEEEVYMGTIPIMTDKGTFIINGAERVVVSQVHRSPGINFEQEKHSKGNVLFSFRIIPYRGSWLEAVFDINDLIYIHIDRKKRRRKILAMTFIRALGYSTDADIIEEFFSVEERSLRLEKDFVALVGKVLADNVVDADSSLVYGKAGEKLSTAMLKRILDAGVQSLKIAVGADENHPIIKMLAKDPTDSYEAALKDFYRRLRPGEPATLVNARSTIMRLFFDAKRYNLGRVGRYKLNKKLGFPLDDETLSQVTLRKEDVIGALKYLIRLRMGDEKTSIDDIDHLANRRVRSVGELIQNHCRSGLARMEKIVRERMNLFDFSSDTLTPGKIISAKGLVSVLKDFFSRSQLSQFMDQTNPVAELTHKRRLSALGPGGLNRERAGFEVRDVHASHYGRICPIETPEGPNIGLITSLSSFAKINEFGFIETPYRVVRDGIVTDEIEYMTADVEEECVIAQASAELDEYDMFKTPVCWARYKGEAFEADTSTVTHMDVSPKQLVSVVTGLIPFLEHDDANRALMGSNMQRQAVPLLKTEAAIVGTGLEGRAAKDSGAIIVAQEDGVVEYVDSYEIVVAKKNNPTLKDRYQLKKFLRSNSGTCINQTPLCSVGDVVTHGDVLADGPATDKGELALGKNVLVAFMPWYGYNFEDAIIISERLIKQDAYTSIYIEEFELTARDTKLGKEEITRDIPNVSEEVLANLGEDGVVRIGAEVKPGDILVGKITPKSETELAPEERLLRAIFGEKAADVKDASLTVPPGTEGVVMDVKVFSRKDRLSKSDDELVEEAVHLKDLQKEYKSQLAQLKVEHREKLGALLLNEKAPAAIIHRRSADILVQEGAIFDQETIELLERESLVDLLMAPCDMYDVLKDILSSYETAVQRLEVNYKTEAEHIKEGDADLDHGVIRQVKVYVASKRKLQVGDKMAGRHGNKGVVSKIVPEADMPFLANGETVQMILNPLGVPSRMNLGQVLETHLGYAAKTAGIYVKTPVFEGFPESRIWDMMIEQGLPEDGKSYLFDGKTGERFDSKVVVGYIYMLKLSHLIADKIHARSIGPYSLVTQQPLGGKAQMGGQRFGEMEVWALEAYGVAHMLQEILTVKSDDVSGRTRIYESIVKGENLLRSGTPESFNVLIKEMQGLGLDVRPMVVDA

SEQ ID NO: 450 - protein, 298 aa, Chlamydia trachomatis serovar D
MLKIDLTGKIAFIAGIGDDNGYGWGIAKMLAEAGATILVGTWVPIYKIFSQSLELGKFNASRELSNGELLTFAKIYPMDASFDTPEDIPQEILENKRYKDLSGYTVSEVVEQVKKHFGHIDILVHSLANSPEIAKPLLDTSRKGYLAALSTSSYSFISLLSHFGPIMNAGASTISLTYLASMRAVPGYGGGMNAAKAALESDTKVLAWEAGRRWGVRVNTISAGPLASRAGKAIGFIERMVDYYQDWAPLPSPMEAEQVGAAAAFLVSPLASAITGETLYVDHGANVMGIGPEMFPKD

SEQ ID NO: 451 - protein, 298 aa, Chlamydia trachomatis serovar D
MSLQKLLVTDIDGTITHQSHLLHDRVVKALHQYYDSGWQLFFLTGRYFSYAYPLFQNFSVPFLLGSQNGSSVWSSTDKEFIYFRSLSRDFLYVLEKYFEDLDLIACIESGASNRDVYFRKGLGKTSQELKAILDAVYFPTPEAARLLVDVQGHLSEEFSYEDFAIAKFFGEREEVKKIMDRFIQSPEVSSQVTMNYMRWPFDFKYAVLLLTLKDVSKGFAVDQVVQTFYKENKPFIMASGDDANDIDLLSRGDFKIVIQTAPEEMHGLADFLAPPAKDFGILSAWEAGELRYKQLVNP

SEQ ID NO: 452 - protein, 153 aa, Chlamydia trachomatis serovar D
MLRLFQHILCFLEEDPSFVDVPQELSFVNEAFSGSMRWEVGRMLGSLLLLLGIFGGGCLLFRRFLRSRGHLPSGNSSIKILDQRVLASKTSIYVIKVANKTLVVAERGERVTLLSEFPPNTDLNELIQKDQKKPSTPRGEMLSGFLKQFKEKK

SEQ ID NO: 453 - protein, 569 aa, Chlamydia trachomatis serovar D
MPKQADYTWGAKKNLDTIACLPEDVKQFKDLLYAMYGFTATEEEPTSEVHPGAILKGTVVDISKDFVVVDVGLKSEGVIPMSEFIDSSEGLTVGAEVEVYLDQTEDDEGKVVLSREKATRQRQWEYILAHCEEGSIVKGQITRKVKGGLIVDIGMEAFLPGSQIDNKKIKNLDDYVGKVCEFKILKINVDRRNVVVSRRELLEAERISKKAELIEQITIGERRKGIVKNITDFGVFLDLDGIDGLLHITDMTWKRIRHPSEMVELNQELEVIILSVDKEKGRVALGLKQKEHNPWEDIEKKYPPGKRVRGKIVKLLPYGAFIEIEEGIEGLIHVSEMSWVKNIVDPNEVVNKGDEVEVVVLSIQKDEGKISLGLKQTKHNPWDNIEEKYPIGLRVTAEIKNLTNYGAFVELEPGIEGLIHISDMSWIKKVSHPSELFKKGNTVEAVILSVDKESKKITLGVKQLTPNPWDEIEVMFPVGSDISGVVTKITAFGAFVELQNGIEGLIHVSELSEKPFAKIEDVLSIGDKVSAKVIKLDPDHKKVSLSIKEFLVHGGDAGHDAEEESSDRD

SEQ ID NO: 454 - protein, 666 aa, Chlamydia trachomatis serovar D
MESLSVRSTIPLPLGAKKLSADRYRFSLFSSQAQQVTLVLLDPLSEIHEIPLSSTDHRTGAIWHIEIAGISSEWSYAYKLRGTDLSSQKFATDSYIADPYSKNIYSPQLFGSPKQEKDYAFSYLKHEDFDWEGDTPLHLPKENYFIYEMHVRSFTRDPSSQVSHPGTFLGIIEKIDHLKQLGVHAVELLPIFEFDETVHPFKNQDFPHLCNYWGYSSVNFFCPSRRYTYGADPCAPAREFKTLVKALHRAGIEVILDVVFNHTGFEGTSCPLPWIDLESYYMVNDHGDLMNFSGCGNTVNTNTPTTLKWILDALRYWVQEMHVDGFRFDLASVFSRDPQGVPLPLTPILQAISSDSILSETKLIAEPWDAGGLYQLGHFPSISTRWSEWNGCYRDHVKAFLNGDAHQVSSFASRISGSHDIYPNGKPTNSINYICSHDGFTLYDTVAYNDKHNEENGEYNRDGTSANYSYNFGCEGETTDPTICALRERQMKNFFLALFLSQGIPMIQSGDEYGHTAYGNNNHWCLDTKINYFLWDRLAERKELFSFLCQVIALRKAYTELFNTSFLSEDTITWLNTKGSPREWGADHYLAFELKHLNYSLFVAFYSGNERIEISLPKPRKEHLAYEKIVDSTTGFFSQILSPKLSLEPYSSLVAISRRKTSLESR

SEQ ID NO: 455 - DNA, 882 bp, Chlamydia pneumoniae
gtgtccaaacatacttctgaatccaggattgctcaagatatgttagaacgttattctggctctagcgtaaagcaattttgtccttatctcttactcacgaacttctcttactatatccaaacctttgcaaaacttcatggggtgcccgtctttgagggttctatgttttctgctgcccatgctcctcatcttaaaacttcaattttagattttaaactagggtctccaggagctgcattaactatagacttatgttcatttcttcctgatctcaaagcagcgcttatgttaggaatgtgtgggggcttacgctctcattatcaggttggagattactttgtccccgtagctagcatacgtggagagggtacttcagacgcctatttccctcctgaagttccggctcttgcaaattttgttgtacagaaagcaacaactgaagttttagaagataagaaggcaaactaccatattggcattacccacacgaccaacattcgcttttgggaatttaacaaaaaatttagaaaaaaactgtacgaaaccaaagctcaatccgctgaaatggagtgtgcgacactttttgctgccggataccgtagaaacctgcccattggagcgttattattgatttcagatcttcccttaaggaaggagggaatcaaaacgaagtccagtgggaacttcatctttaatacttatacggaagaccacatcttaacaggacaagaagtcatagagaaccttgaaaaagtcatgctaaaacgagcagcttctgaccataagaaggatcaacagtatcgaggattacctcatatggaagttggagaagccgatgacactatggctagcggctctgaaacttccgacagtgactattga

SEQ ID NO: 456 - DNA, 1185 bp, Chlamydia pneumoniae
atgtcaaaagaaacttttcaacgtaataagccccatatcaatattgggacgatcgggcacgttgaccatggtaaaactacgctaacagcggcaattacacgcgcgctatcaggggatggattggcctctttccgtgactatagttcaattgacaatactccagaagaaaaggctcgtggaattactatcaacgcttctcacgttgaatacgaaaccccaaatcgtcactacgctcacgtagactgccctggtcacgctgactatgttaaaaatatgattacaggcgccgctcaaatggacggagctatcctagtcgtttcagctacagacggagctatgccacaaactaaagaacatatcttgctagctcgccaggttggagttccttatatcgttgttttcttgaataaagtagatatgatctctcaagaagatgctgaacttattgaccttgttgagatggaacttagtgagcttcttgaagaaaaaggctacaaaggatgccctattatccgtggttctgctttgaaagctcttgaaggtgatgcaaattatatcgaaaaagttcgagaacttatgcaagctgtggatgacaacatccctacaccagaaagagaaattgataagcctttcttaatgcctatcgaagacgtattctcaatctctggtcgtggtactgtggttacaggaagaatcgagcgtggaatcgttaaagtttctgataaagttcagctcgtgggattaggagagactaaagaaacaatcgttactggagtcgaaatgttcaggaaagaacttcctgaaggtcgtgcaggagaaaacgttggtttactcctcagaggtattggaaagaacgatgttgaaagaggtatggtggtttgtcagcctaacagcgtgaagcctcatacgaaatttaagtcagctgtttacgttcttcagaaagaagaaggcggacgtcataagcctttcttcagcggatacagacctcagttcttcttccgtactacagacgtgacaggagtcgtaactcttcctgaaggaactgaaatggtaatgcctggagataacgttgagcttgatgttgagctcattggaacagttgctcttgaagaaggaatgagatttgcaattcgtgaaggtggtcgtactatcggcgctggaacgatttcaaagatcaatgcttaa

SEQ ID NO: 457 - DNA, 1656 bp, Chlamydia pneumoniae
atgccacaaaaagtcctgattacttcagctttaccctatgctaatggtccgctacattttggacatattgcaggagtctatcttcctgcagatgtgtatgcaagattccgtagattgttaggagacgatgtcctttatatttgtggttccgatgaatttggcatagcgatcaccttaaatgcggatcgtgaggggttggggtatcaagagtacgtggatatgtaccataagttacataaagatacttttgagaagttagggtttgctttggatttcttttctaggacgacgaacccttttcatgctgagcttgtccaagatttttattcccaacttaaagcgtctggattgattgaaaatcgcatatctgaacaactgtattcagaacaagaacaacgttttcttgcggatcgttatgtagaagggacgtgtcctcggtgcggttttgatcatgctcgaggagacgagtgtcagagctgtggtgcggattatgaggctatagatttaatcggccctaagtctaagatttctggggttgagttagtaaaaaaagagactgagcactcatattttcttttggaccgtatgaaagacgctctactttcttttattcagggatgctatttacctgatcatgtccgtaaatttgttgttgattacatagaacatgtcaggtctcgagccattactcgagatttatcttgggggattcctgttccagactttcctggaaaggtgttttatgtatggtttgacgctcctataggatatatcagtggaactatggaatgggcagcttctcaaggaaaccctgacgaatggaagcgtttctggcttgaagacggtgtagagtatgtccagtttataggtaaagataatcttcctttccattctgtagttttcccagctatggaattgggtcagaaacttgactataaaaaagttgatgccctcgtagtttcagagttttatcttttagaaggacggcaattcagtaaatccgagggcaattatgtggatatggacaagtttttgagttcctattccttagacaaattgcgctatgtattggcggctacagctcctgaaacttcggatagtgagtttactttccttgattttaagactcgttgtaattctgagttggtaggaaagtttgggaattttataaaccgagttcttgcttttgcagaaaagaatcactatgacaagctttcttatcattctgtggttttagaagatagtgacagggcatttcttgaagaagcgcgtcaacttgttcgagatgctgagaagtgctacagagagtatagtttacgtaaggctacgagtgtgattatgtcactggcagctttagggaatgtctattttaaccaacaagcaccttggaagctattgaaagaagggactcgtgagcgtgttgaggccattttattctgcgcatgttattgtcagaagttgttagctttaatttcttatcctattattcccgaaagcgctgtagctatttgggagatgatctcaccaaaatctttagaaaattgcaatttggatacgatgtatgctagggatctatggaaagaagaaattcttgatgttataaacgaagaatttcatttgaagtcccccaggttattatttactactgtagagtag

SEQ ID NO: 458 - DNA, 294 bp, Chlamydia pneumoniae
atgattaaaaaagatcgtttcactaatgaaaagttaaataagcttttcgatagtccttttagcctagtgaactacgcgattaaacaagcaaagatcaaaattgccaaaggcgatgttcgctcctctaatgttgcgatcgaaacactcgtcttgttagatagagaagggatacagcctgagtttactgaagagattgtagtaactgctagccctactgtggaaagaaagagatcagaacatacaaattctagaaaaaaagatccctcagcatatacttggagtgatgtaaagtaa

SEQ ID NO: 459 - DNA, 618 bp, Chlamydia pneumoniae
atgaataagatcctagttgactctcctttttctccagatcaccagaagtgctgtcctaagctttttacaattagtgctcctgctggagttggaaagacaacacttgtccgtatgttagagcaagagttttcttctgcttttgctgagactatatcggtaacaacaaggaaacctcgagagggtgaagtcccaggtaaagattatcattttgtttcccacgaagaatttcaaagacttttggatcgtcaggctctcttagaatgggtgttcttattcggagagtgttacggaacaagtatgttagagattgaaagaatttggagcctagggaagcacgctgttgctgttattgatatccaaggagccttgtttattcgctctcggatgcctagtgtatctatttttattgctccaccttcacaggaggagttagaaagaaggttagcttcacggggatctgaagagggctctcaaagaaaagaacggctggagcacagtcttattgagctagcagctgcaaatcagtttgattatgtcattattaacgacgacttaaatcaagcgtacagggttttaaaaagcatttttatagctgaagaacataggaacatattatga

SEQ ID NO: 460 - DNA, 1809 bp, Chlamydia pneumoniae
ttgaaagaatataagatagagaacattcgcaatttttcaatcatagcgcatattgatcacgggaagtctacaattgctgatcgccttttagaaagtacgagcacagtagaagaacgggagatgcgtgagcagctcttagattccatggatcttgaaagagagcgtggcattacaattaaagctcatcctgtcaccatgacgtatctatatgaaggagaggtgtatcaactgaacctgattgatacccctggtcacgtggacttttcgtatgaagtctctcgatctctatctgcatgtgagggcgccttacttattgtagatgccgcccagggggtgcaggcacaaagtcttgctaatgtctacctggcccttgaaagagatttagagatcattcctgtattaaacaagattgatctacctgccgctgatcccgtgagaattgctcaacagattgaagattatataggcctagacactacgaacattattgcctgttctgcaaaaacaggtcaggggatccctgcaatcctgaaagcaattatcgatcttgttcctcctccaaaagcacctgcagaaacagagcttaaagctttagtctttgattctcattatgacccttacgttggcattatggtctacgtacgcattattagcggggaattaaaaaaaggagaccgcattacttttatggcggctaaaggctcctcgtttgaagtcttaggtataggggcctttctccctaaagcaacatttatagaaggttccttacgccctggtcaggtgggtttttttattgccaatctcaaaaaagtgaaggatgtgaagatcggcgatacagtcacgaaaacaaaacatcctgcaaaaactcctttggaaggcttcaaagagatcaatccggtagtttttgctggaatttatcctatagattcttctgattttgatactttgaaagatgctttaggaagactacagctcaatgattctgctttaactatagaacaagaaagcagtcactctttaggctttggttttcgttgtggcttcttaggacttcttcatcttgagattatctttgaaagaatcattcgagaatttgacttagatattattgcaacggctccaagtgtcatctataaagtcgtcttaaaaaacgggaaagttctagatattgataacccctcaggatatccggatcctgcgatcatcgagcatgtggaagagccttgggttcatgtgaatattatcacccctcaagaatatctgagcaacattatgaacctctgtttagataaacgtgggatctgcgtaaaaacagaaatgctagatcagcaccgtctagttcttgcttacgaactccctttaaatgagattgtctcggatttcaatgacaagctgaagtcagtaactaaaggttatggatcctttgactaccgtcttggggattaccgtaagggatcgatcatcaaattagaggttcttattaacgaggagcccatagatgctttttcttgtttagtccatagagataaagcagaatctcgtggaagaagtatctgcgaaaagcttgtggacgtgattccacaacaactcttcaagattcccatccaagctgccattaacaaaaaagtcattgccagagaaacgattcgtgcgctttctaagaacgtgaccgcaaagtgttatggcggagatattactaggaaacgcaagctgtgggaaaagcaaaagaaaggaaaaaaacgtatgaaggaatttggaaaagtttccattcccaatacagctttcattgaagttctaaaattagattaa

SEQ ID NO: 461 - DNA, 975 bp, Chlamydia pneumoniae
atggaacttcttccacacgaaaaacaagtagttgaatatgaaaaggctatagccgaatttaaagaaaaaaataagaaaaattctctcttatcttcttcagagattcagaaattggaaaagcgtttagataaattaaaagaaaagatctattcggatttgactccttgggagcgtgtacaaatatgtcgccacccttcgcgtccccgtactgtcaactatattgaagggatgtgtgaggagtttgtcgagctttgtggagatcgcaccttccgagatgatcccgcagttgttggtggctttgtaaaaatccagggtcagcgttttgtccttattggccaagaaaagggatgcgatacagcgtcacgccttcataggaacttcggtatgttatgtcccgagggtttcagaaaagcccttcgcttaggaaaactcgctgaaaagtttggcttgcctgtggtctttcttgtcgataccccaggagcatatcctggattgactgctgaagagagaggacaaggatgggcaattgccaaaaatctttttgagctctcaagacttgccactcccgtgattattgtcgttatcggtgagggatgttcaggtggagctttgggcatggctgtaggtgattctgtagctatgttagagcattcctattattctgtaatttccccagaaggatgcgcctccattctttggaaagatcctaagaaaaatagcgaagcagcttccatgttgaaaatgcatggagaaaacttaaaacaatttggcattatcgatactgttatcaaagagcccattgggggagctcaccacgatcctgcattggtatatagcaatgttcgagagtttatcatccaagagtggttacgattaaaagatctagctatagaagagctgttggagaaacggtacgaaaaatttcgctctataggtctttatgaaactacttctgaaagcggtcctgaggcataa

SEQ ID NO: 462 - DNA, 1980 bp, Chlamydia pneumoniae
atgaaactacttctgaaagcggtcctgaggcataaaaatcatctcgttatattaggctgttctctactcgcaattttaggacttaccttttcatctcagatggagattttttctttagggatgattgctaaaacaggccccgacgcctttttactttttggacgtaaggaatctggaaaacttgtaaaggtttcagaactaagtcagaaagatattttagagaattggcaggcaattagtaaggattcagagacacttacagtctctgatgccacgacatacatcgccgaacatgggaaaagcacagcctctctgacgagcaagctctctaagtttgtccgtaactacatcgatgtgagccgctttcgaggactggcaatcttcttaatctgcgttgctatttttaaagcagtcaccttatttttccaacgtttccttgggcaagtcgttgctatacgggtaagccgagacttacgtcaggactactttaaggccctacaacaactccccatgaccttcttccatgatcatgatatcggtaatttaagtaatcgtgtcatgacagattctgcaagcattgccttagcagtaaactctttaatgattaactacattcaagccccaattaccttcatattgacattgggagtctgtctgtcgatttcatggaagttttcaattcttatttgtgttgcctttcctatctttatccttcccattgtcgtgatcgctagaaagatcaaaaatttagcaaaacgtattcaaaagagtcaggattcattttcctccgttctttatgattttcttgctggggttatgacagtaaaagtctttcgtacagaaaaatttgccttcacaaaatattgtgagcataacaataagatttctgctttagaggagaaaagtgctgcttacggtttgcttccacgacccctcctgcataccatagcttctttattttttgcttttgtcgtcgttatcggaatttataaatttgctattcctcccgaagaacttatcgtattttgtggtttgctctacctaatctacgaccctattaagaagttcggggatgaaaatacctccatcatgaggggatgtgctgctgcggagagattttatgaagtcttgaatcaccccgatcttcatagtcaaaaagaaagagaaatcgagttccttggactttctaatacaatcacattcgagaatgtttccttcggctatcaggaagataagcacatcctcaaaaatctaagctttaccttacataaaggcgaagctctaggcattgtaggacctacaggatctggaaaaacaacacttgttaaattacttcctaggctctacgaagtctcccaaggaaagattcttatcgactctcttcctattacggaatataacaaagggtccttaaggaatcacatcgcctgtgtattacagaatcctttcttattctatgatactgtatggaataaccttacctgtggtaaggatatggaggaggaggctgttttagaagctctaaaacgtgcctacgctgatgagtttattttaaagctccctaaaggagtccatagcgtgctcgaagaatctgggaagaatctctcaggaggacagcagcaacgtttggcaatagcacgtgctctgttgaaaaacgcctccatcttaattttagatgaggcaacgtcagctctagatgccattagtgaaaattacattaagaatatcattggagagcttaaaggacagtgcacacaaatcattattgcccacaagctgaccactcttgaacatgtagatcgcgtgctctacatagaaaatggtcaaaaaattgccgaaggcacaaaagaagaactcttacagacgtgtcctgaatttttaaaaatgtgggagctctcagggactaaagaatataacagggtctttgttcctgatcacaaattagtcgcaaatcctacggacatggcaataacaacttag

SEQ ID NO: 463 - DNA, 1236 bp, Chlamydia pneumoniae
atgattcctaccatgttaatgttcttcattatctgttttactttatgctcgggattcatttcgttatctcaaattgctttgttttctttgcctacgagtttgatctcgcactataagcgctctaaatctaagaaacagcagcgagtagctacccttcttctacatccccaccacctgctcatcaccttaattttttgtgatatcggactgaatattgctattcaaaactgttttgccattctatttggagatgcagcttcgtggtggtttactgtaggtcttcctttagcaattactttgatcttaggtgagattctccctaaagcagtagctcttccttttaatacacagattgctagttccgtagcccctcttattctttgtgttactaaaatcttcaaacccctactccactggggtatcgtaggaattaattatgtggtccaatggattttatcgaagcaacagattgatatcatccaaccccaagagctgaaggaagtattgcaaagttgtaaggatttcggcgtagtcaatcaagaagaaagccgtttactctatggttatctttctcttagtgattgtagtgttaaagagcgtatgcagccacgccaggatattttattttatgatatccaaacccctttagagaacctctatcttttattttctaaacagcattgctcacgagttcctatatgtaacgataacctccaaaaccttctgggcatttgcacagcgcgctctcttcttttacatgacaagccactgcaatcttcggatgatctcctccccttgctgaaaaaaccgtattatatgccagaaaccatctctgcaaaaatggctttatgtcagatggcagctgaagacgaaaccctagggatgatcattgatgaatacggatctattgaaggattgatcactcaagaagacctctttgaaattgttgctggagaaattgtagaccagagagataataaaatactctataccacctcaggagctgatgttattattgcctcaggaactttagaactccgtgagtttagtgagatcttcgatatcaacctaccgacgaacaataatattgcgactataggaggctggttaatagagcaaatcggaacgattccgacaacaggaatgaaactctcttggaataacttgcttttccaggtattagacgctgctccgaatcgcattcgccgtgtgtatataaggaaattgtatgactaa

SEQ ID NO: 464 - DNA, 1215 bp, Chlamydia pneumoniae
atgactaattctgctctcttttggataggagtcaacattatctgtattgtcttacaaggattctattcgatgatggaaatggcctgcgtgtcatttaaccgtgtacgattgcaatactatctgactaaagatcataagaaagctcgctacattaatttcctgattcgccgcccctatcgtttatttggaacggtgatgttaggagtgaatatcgctctacaagtcgggtctgagtcctcaagaaattgctatcgagctttaggaatcactccagattacgctcctttcactcaaatttttatagttgtgatttttgcagaacttctacctctaacaatatcacggaagattcctgaaaaattagcactttggggagcaccgattctctattattcccactatattttctatcctctgattcagctcataggaagtctcactgagggtctttactatcttctaaatattaggaaagaaaaattgaactctacattaagtagagacgagttccaaaaagctttagagactcaccatgaagaacaagatttcaatacaattgctacaaatattttctctttaagtgcgacttgtgcagatcaggtatgccaacctttagaacaggttaccatgcttccttcttctgcaaatgttaaagatttttgccggactataaaaaatacagatatcaactttattcctgtctatcacaaggcccgaaaaaacgttattgggattgcccatcctaaagactttgtcaataaagctcttgatgaacccctaatcaataatctacactcgccttggtttatcactgcaaaatcaaaacttattcgtatcctcaaagagtttcgagacaaccgttcgagtgttgctgttgtcctcaatgcttctggtgaacctataggtattcttagtttaaatgcaattttcaaaatcttattcaacactacaaacattgctcatttaaaacccaagaccatctctgttattgaaagaacgtttcctggcaactctcgcataaaagatctgcaaaaagaactcgatattcaatttccgcaatatcctgtagaaaccctagcccaattggtattgcaactgctagacagtcctgcagaagtaggaacttctgtaattatcaacaacttgcttttagaagttaaagagatgtctttatctgggataaaaaccgtatcgattaaaaacttactctcatag

SEQ ID NO: 465 - DNA, 1632 bp, Chlamydia pneumoniae
ttgttcggctcggagtccctccgttatcaattgttgatccaagattttgcaaaagtttcagaagagggcataggccttttggagtctaaagagtattctttacttcaggctaagctagttttaagggctctggctcaaaattcttcttttgatgattggtttagaagttttaagaagtgtcagatttcctatccagagttagctcatgatcgcgatgtcttagaagaatttgggattcaagttctgcgtgagggaatcgaaaatccttccgtgaccgttcgtgctgtgagtgtccttgctattgggcttgctagagattttcgcttggtccctctcctgctccaaagttgtaatgatgacagtgctattgttcgatctttggctcttcaggttgctgtgaactatggctctgaaagtttaaaaaaggccattgtagagcttgcccgtaatgatgattctattcatgttcggattacagcatatcaggtggtcgctcttttacagatagaggagctattgccatttttaagagagcgtgctgagaacaaacttgtagatagtgtagaacgtcgagaggcgtggaaggcttgcttggaactctcttctcaatttctagagacgggtgtagctaaggacgatattgatcaagcgttgttcacttgtgaagtgttgcgtaacggtatgttgccagagactactgagatttttacagaactcttatctgtagagcatcctgaagtgcaggagtctctcttactttctgctttagcttggagtcatcagctacagaatcacaaagagtttcttagtaaagtgcgccatgtgatgtgcacttctccatttgcaaaagtacgttttcaagctgctgcacttctccatctgcatggagaccctttgggcagagactctctggttgagggcttgcgctctcctcaacctcttgtgtgtgaggcagcttcggcggctctctgctctttaggaatccatggagtccctttggcaaaggagcatttggagagcctttcttctcgaaaggctgctgcgaacctctccattttgcttcttgtgagccgtgaagatattgaaagagctggagatgtgattgctcgctacctctccaatcctgaaatgtgctgggctatagagtatttcttatgggatgcacaatggaatttacgtggtgataccttccctctatattcggatatgattaaacgtgagattggtaggaagctcattcgccttttggcagtagctcgctatagccaagccaaggctgtaacagcaacgttcctttcaggacagcaagctcagggatggagctttttttctggaatgttctgggaagagggagatgtgaaaacttctgaggatttggttacagatgcttgctttgcagcaaagttggaaggagcgttagcctcgctatgtcagaaaaaagatcaagcttccctacagagggtctctcaactttataatgacagccgttggcaagataaattagcaatcttagagagcgttgctttttctgagaatcttgatgctgtgccttttcttctagactgctgccatcacgaagctccttcgctgcgaagtgcagcagcgggtgctcttttctctattttcaaataa

SEQ ID NO: 466 - DNA, 312 bp, Chlamydia pneumoniae
atgtcatttaaacgtttcttgcaacagatccctgtacgtatctgtctacttattatctatctctaccaatggcttatctcccctctcttaggctcgtgctgtagattttttccttcctgttcgcactatgcagaacaagccttaaaatctcacggcttcctgatgggctgctggctttctataaagagaatcggaaagtgtggcccctggcatcctggaggcattgacatggtccctaagactgctttgcaggaagttttagaaccttaccaggaaatagacggtggtgattcaagccatttttctgaatga

SEQ ID NO: 467 - DNA, 1089 bp, Chlamydia pneumoniae
atggctttcaaaagaaaaactagatggctgtggcaagtcttgatcctgagtgtgggattgaatatgctttttttgctcttattttactctgccatatttcgtaaagacatctataagctgcatttattttccggacctttgattgcgaaaagtagtcgtaaggtctacctttctgaagattttttaaacgagatatctcaagcatctttggacgacttgatttcgttgttcaaagatgagcgctatatgtatggtcggccgataaaactttgggcgttgagtgtagcgatagcttcccaccacatagacatcactcctgtgctttcgaagcctttgacctatacagagttgaaaggatcttcagtgcggtggcttttgccgaatattgatcttaaagactttcctgtgattttggactatttgcgttgccacaagtatccctatacttctaagggcttgtttttgctgatagaaaagatggtacaagaaggctgggtagatgaagattgcctgtatcatttctgctcgactccagaatttctttacttgcgtacgttacttgtaggtgcagacgtgcaggcctcttcagtagcctcattagctcgtatggtgattcgttgcggatccgaacgtttctttcatttttgcaatgaagagagccgcacttccatgatttcagctacacaacgtcagaaagtcttaaaatcttatttagattgtgaagaatctctggcagccttgcttttgcttgtccatgatagtgatgttgttttgcatgaattttgtgatgaagatcttgagaaggtcatccgcctgatgcctcaagagtctccctatagtcagaatttcttctctcgattacagcattctccgcgtagagagttggcctgcatgtcgactcagagggtagaggctcctcgtgttcaagaagatcaggatgaagagtatgtggtacaggacggggattctttatggttgatagctaagaggtttggcattcctatggataagatcattcagaaaaatggcttgaatcaccaccgtctatttcctggtaaggttctaaaacttcctgcaaagcagtcttag

SEQ ID NO: 468 - DNA, 1308 bp, Chlamydia pneumoniae
atgttttcacgatggatcaccctctttttattattcattagccttactggatgctcctcctactcttcaaaacataaacaatctttaattattcccatacatgacgaccctgtagctttttctcctgaacaagcaaaacgggccatggacctttctattgcccaacttctttttgatggtctgactagagaaactcatcgcgaatccaatgatttggaattagcgattgccagtcgctatacagtctctgaagacttttgctcttatacgttctttatcaaagacagcgctttatggagcgacggaacaccaatcacctccgaagatatccgtaacgcttgggagtatgcacaggagaactctccccacatacagatcttccaaggacttaacttctcaactccttcatcaaatgcaattacgattcatctcgactcgcccaaccccgattttcctaagcttcttgcctttcctgcatttgctatctttaaaccagaaaacccgaagctctttagcggtccgtatactcttgtagagtatttcccagggcataacattcatttaaagaaaaaccctaactattacgactaccactgcgtctccatcaactccatcaaactgctcattattcctgatatatatacagccatccacctcctaaacagaggcaaggtggactgggtaggacaaccctggcatcaagggattccttgggagctccataaacaatcgcaatatcactactacacctatcctgtagaaggtgccttctggctttgtctaaatacaaaatccccacacttaaatgatcttcaaaacagacatagactcgctacttgtattgataaacgttctatcattgaagaagctcttcaaggaacccaacaaccagcggaaacactgtcccgaggagctccacaaccaaatcaatataaaaaacaaaagcctctaactccacaagaaaaactcgtgcttacctatccctcagatattctaagatgccaacgcatagcagaaatcttaaaggaacaatggaaagctgctggaatagatttaatccttgaaggactcgaataccatctgtttgttaacaaacgaaaagtccaagactacgccatagcaacacagactggagttgcttattacccaggagcaaatctaatttctgaagaagacaagctcctgcaaaactttgagattatcccgatctactatctgagctatgactatctcactcaagattttatagagggagtaatctataatgcttctggagctgtagatctcaaatatacctatttcccctag

SEQ ID NO: 469 - DNA, 1749 bp, Chlamydia pneumoniae
gtgtctgggaagaaagatggtgtaaggggaatgatctttgtccctcttagcatcctagtactaatctttttacctcttcctcagatccttcttgattttggattgtgtattagttttgcattgtctttactaacggtctgttgggtctttaccttaaattcaagcaattcagcgaagctttttcctccatttttcttatatctttgcctattgcggttgggattgaatcttgcatcaacacgatggattgtctcttcaggaaccgcctcttctctgattgtttctttaggcagtttcttctctttaggaagtctatgggcagcaacgtttgcgtgcctccttcttttctttgtgaactttttgatggtttcaaagggttcggaaagaatcgcagaggtccgttcgcggtttttcttagaggctcttccagcaaaacagatggctttagattctgatcttgtttctggaagagcttcttataaggctgtcaaaaaacaaaaaaatgcccttatagaagaaggggatttcttctctgccatggagggggtctttcgttttgttaaaggggatgcaattattagttgtatccttttactcgtgaacgtagtttctgtaacttgtctttattatacttcgggttatgctcttgagcagatgtggtttacagttttaggagatgctttagtgagtcaagtacctgctttacttacttcgtgtgctgcagccactcttattagtaaaatcgataaggaagagagccttttaaattacctgttcgaatactacaaacagttgcgtcagcatttcagggtggtgtcgttattgatcttttctttgtgctgcattcccagttctccaaaattccctatcgttttgctcgcgagtcttttatggttggcgtatcgaaaagaagagcctgcatcagaagattcttgtatagaacgtgcgttctcttatgttgagggggcctgccctaaggaacaagaatcacagttctatcaagtatatcgtgcagcatccgaagaagtatttgaagatttaggagttagattgcctgtgcttacttctctacgtattgaagagcgtccttggctccgagtatttggccagaatgtatacttagatgaaatgactccagaggctgtgcttcctttccttagaaacatcgctcatgaggctctcaatgccgaggtagttcaaaagtaccttgaggaatcagagagagtgtttggcatcgctgttgaagacatcgttcctaagaaaatctctttaagctctcttgtagttctttctcgcctccttgttagagaaagggtatcgcttaagcttttcccaaagattctagaggccgttgcggtataccaaaattctggagacagcttggagatccttgcggaaaaagtgcgaaagtctctcggatattggattgggagaagtctctgggatcagaaacaaacccttgaggtaattaccatagattttcatgttgaagaattgataaacagctcatactcaaagtctaatcctgtaatgcaagagaatgtgatccgtcgagtagacagtcttttagaacggtcggtatttaaagattttcgagccatagttacgagctgtgaaacacgatttgagatgaaaaaaatgctcgacccacatttccctgatcttttggttttatctcatgatgagcttcctaaagaaatccctatttccttcttagggatcgtttcagatgaggttttagttccttaa

SEQ ID NO: 470 - DNA, 516 bp, Chlamydia pneumoniae
atgaaaaaattattattttctacatttcttcttgttttaggatcaacaagcgcagctcatgcaaatttaggctatgttaatttaaagcgatgtcttgaagaatccgatctaggtaaaaaggaaactgaagaattggaagctatgaaacagcagtttgtaaaaaatgctgagaaaatagaagaagaactcacttctatttataataagttgcaagatgaagattacatggaaagcctatcggattctgcctctgaagagttgcgaaagaaattcgaagatctttcaggagagtacaatgcgtaccagtctcagtactatcaatctatcaatcaaagtaatgtaaaacgcattcaaaaactcattcaagaagtaaaaatagctgcagaatcagtgcggtccaaagaaaaactagaagctatccttaatgaagaagctgtcttagcaatagcacctgggactgataaaacaaccgaaattattgctattcttaacgaatctttcaaaaaacaaaactag

SEQ ID NO: 471 - DNA, 1083 bp, Chlamydia pneumoniae
atgtccgaagcaccagtctacactcttaaacagttagctgagctactacaagtcgaagttcaaggaaatatagaaactcctatttcaggtgttgaagatattagtcaggcgcaacctcaccatattgcttttttagataatgagaaatactctagctttctaaaaaacaccaaagctggtgctattattttatctagatctcaggcaatgcaacatgcccacctaaagaaaaactttcttattaccaatgaatccccttctctaacatttcaaaagtgcatagagttgtttattgaacccgtaacatcagggtttcctggtattcatcctactgcagtgattcatcctactgcacgtattgagaaaaatgtaaccatagaaccttacgttgtcattagtcaacatgcccatatcggctctgacacatacatcggagctggaagtgtcattggagctcacagcgttctaggtgctaactgtctgattcaccctaaggtggtgattcgagaaagagtcctcatgggaaaccgtgtagttgttcaacctggagctgttttaggatcctgtggttttggttatattacaaatgcttttggtcatcacaaacctttaaagcatctaggctatgtgattgtaggtgatgatgtagaaatcggagccaacactacgatagatcgtggtcgattcaagaacaccgtgatccatgaaggaactaaaatagataaccaagtacaagtagctcatcacgtagaaattggaaagcatagtattattgttgcccaagcaggcattgcaggttctacaaaaattggtgaacatgtcatcattggagggcaaaccggaattactgggcatatttctattgcagaccatgtgatcatgattgctcaaactggagtcacaaaatctatcacctctccaggcatttatggaggcgctccagcacgaccttatcaagaaacacatcggttgattgctaaaattcggaaccttcctaaaactgaagaaagactaagtaagttagaaaaacaagtaagagatctatcgactcccagccttgctgagattccttcagagatctaa

SEQ ID NO: 472 - DNA, 1200 bp, Chlamydia pneumoniae
atggcagcatcaggaggcacaggtggtttaggaggcactcagggtgtcaaccttgcagctgtagaagctgcagctgcaaaagcagatgcagcagaagttgtagccagccaagaaggttctgagatgaacatgattcaacaatctcaggacctgacaaatcccgcagcagcaacacgcacgaaaaaaaaggaagagaagtttcaaactctagaatctcggaaaaaaggagaagctggaaaggctgagaaaaaatctgaatctacagaagagaagcctgacacagatcttgctgataagtatgcttctgggaattctgaaatctctggtcaagaacttcgcggcctgcgtgatgcaataggagacgatgcttctccagaagacattcttgctcttgtacaagagaaaattaaagacccagctctgcaatccacagctttggactacctggttcaaacgactccaccctcccaaggtaaattaaaagaagcgcttatccaagcaaggaatactcatacggagcaattcggacgaactgctattggtgcgaaaaacatcttatttgcctctcaagaatatgcagaccaactgaatgtttctccttcagggcttcgctctttgtacttagaagtgactggagacacacatacctgtgatcagctactttctatgcttcaagaccgctatacctaccaagatatggctattgtcagctcctttctaatgaaaggaatggcaacagaattaaaaaggcagggtccctacgtacccagtgcgcaactacaagttctcatgacagaaactcgtaacctgcaagcagttcttacctcgtacgattactttgaaagtcgcgttcctattttactcgatagcttaaaagctgagggaatccaaactccttctgatctaaactttgtgaaggtagctgagtcctaccataaaatcattaacgataagttcccaacagcatctaaagtagaacgagaagtccgcaatctcataggagacgatgttgattctgtgaccggtgtcttgaacttattcttttctgctttacgtcaaacgtcgtcacgccttttctcttcagcagacaaacgtcagcaattaggagctatgattgctaatgctttagatgctgtaaatataaacaatgaagattatcccaaagcatcagacttccctaaaccctatccttggtcatga

SEQ ID NO: 473 - DNA, 675 bp, Chlamydia pneumoniae; identical to SEQ ID NO: 377

SEQ ID NO: 474 - DNA, 741 bp, Chlamydia pneumoniae
atgaaaatcaccacagtcaaaacaccaaaaatatatccttatgatgacctatattctattctagagtcttcattgcctaagttaaacgaacgctctattgttgtgattacgtctaagatagtctctttatgtgaaggtgctgttgtagaacttgagaaggtttctaaagatgaattaataaagcaagaagcagatgcctatgtttttgtagagaaatacggcatatatctaactaagaagtgggggatactcattccttcagcggggattgacgagtccaatgttgaaggttattttgtgttgtatcctagggattttttgctttccgtgaatactctaggggattggttaaggaatttctatcatctcgagcattgcggaatcattatatcggatagtcatacgactccgttgcgtcggggaactatgggtttaggcttatgttggaatggttttttccctttatataattatgtaggaaaaccagattgttttggtcgtgctttgaagatgacttatagcaatttattagatggtttatcggcagctgcggttctttgtatgggagagggagacgagcagactcccattgctattatagaggaagctcccaagattaccttccattcttctccaactacattacaagatatgagcactttagcaatcgctgaggatgaagatttatatggtcctctgctacaatctatggcatgggaaactcccgcaccaacctcctga

SEQ ID NO: 475 - DNA, 1062 bp, Chlamydia pneumoniae
atgaataaaagacaaaaagataaattaaaaatctgtgttattattagcacgttgattttagtaggaatttttgcaagagctcctcgtggtgacacttttaagacttttttaaagtctgaagaagctatcatctactcaaatcaatgcaatgaggacatgcgtaaaattctatgcgatgctatagaacacgctgatgaagagatcttcctacgtatttataacctctcagaacccaagatccaacagagtttaactcgacaagctcaagcaaaaaacaaagttacgatctactatcaaaaatttaaaattccccaaatcttaaagcaagccagcaatgtaactttagtcgagcaacctccagcagggcgtaaactgatgcatcaaaaagctctttccatagataagaaagatgcttggctaggatctgcgaactacaccaatctttctctacgtttagataataatctcattctaggaatgcatagctcggagctctgtgatctcattatcacaaatacctctggagacttttctataaaggatcaaacaggaaagtattttgttcttcctcaagatcgtaaaattgcaatacaagctgtactcgaaaaaatccagacagctcagaaaaccatccaagttgctatgtttgctctgacccactcggagattattcaagccttacatcaagcaaaacaacgaggaatccatgtagatattatcattgatagaagtcatagcaaacttacttttaagcaattacgacaattaaatatcaataaagactttgtttctataaataccgcaccctgtactcttcaccataagtttgcagttatagataataaaactctacttgcaggatctataaattggtctaaaggaagattctccttaaatgatgaaagcttgatcatactggaaaacctgaccaaacaacaaaatcagaaacttcgaatgatttggaaagatctagctaagcattcagaacatcctacagtagacgatgaagaaaaagaaattatagaaaaaagtcttccagtagaagagcaagaagcagcgtga

SEQ ID NO: 476 - DNA, 561 bp, Chlamydia pneumoniae
gtggcattaaattttaagattaacaggcaaataagagctcctaaagttcgtctcattggttcagccggagaacagttaggaatacttgctatcaaagatgctttggatttagcccgagaggcaggtcttgatttagttgaagttgcttcaaatagcgagcctcctgtatgtaagatcatggactacggtaaataccgttatggtctgacaaaaaaggaaaaagatagtaaaaaagctcaacatcaggtgcgcataaaagaagttaagcttaagcctaacatagacgaaaatgatttttcgactaagttaaagcaagcgcgtacgttcgttgaaaaaggaaataaagtcaaaattacatgcatgttccgtggtagagaattagcttatccagaacatggttttaaagttgttcaaaaaatgagtcagggtttagaggatattggtttcgttgaagctgaacccaaactagcaggtcgttccttgatttgtgttgtggctccaggaacagtaaaaacaaagaaaaaacaggaaaagtctcatgcccaagatgaaaaccaataa

SEQ ID NO: 477 - DNA, 3135 bp, Chlamydia pneumoniae
atggtcgaagttgaagaaaagcattacaccatcgtcaaacgtaatggaatgtttgtcccatttaatcaagatcggattttccaggctttggaggcagcttttcgagatacgcgtagcttagaaactagttctccactacctaaagacttagaagaatctattgcgcaaattactcataaagtcgtgaaggaagtcctcgctaaaatttcagaaggtcaggtagtcactgtagagagaatccaggatcttgtagaaagtcagctctatattagcgggttgcaggatgtggctcgcgattatattgtttacagggaccaacgcaaggcagagcgcggtaactcttcgtccataattgccatcatacgtagagacgggggaagcgctaaatttaatcctatgaagatctctgcagctctcgaaaaagcattcagagcgacgctccaaattaatgggatgactcctcctgcaacactatccgaaattaatgaccttacccttaggatcgttgaagatgtcctaagccttcatggtgaagaagctattaatctggaagagatccaagatattgttgaaaagcaacttatggttgccggctattatgatgtggccaagaattatattttatatagagaagctcgtgcacgagcccgtgctaataaagatcaagatggacaagaagagtttgtcccccaagaggaaacgtacgttgttcaaaaagaagacggcaccacctaccttctgagaaaaacagatttagaaaagaggttttcttgggcatgcaaacgctttcctaaaactacagattctcaactgcttgcagatatggcatttatgaatttgtattcaggaatcaaagaagacgaggtcaccacagcatgcatcatggcggcacgtgccaatatcgagagagaacctgattacgcttttatcgcagcagaactcctcacgagttccttgtatgaagagaccttaggatgcagctctcaagaccccaatttatcagaaatacataaaaaacattttaaagaatacatcctcaatggagaagagtatcgcttgaatcctcaattaaaggattatgatctcgatgctcttagtgaagtcctagacctctctagagaccaacagttttcctatatgggagtccaaaatctctacgatcgctattttaatctgcatgaaggacgacgtttagagactgcgcagatcttttggatgcgggtttctatgggcttagccttaaatgaaggagaacaaaagaatttttgggcaatcactttctataatctgttatccacattccgctataccccagcaactcctacattgtttaactccggaatgcgtcattcccaactcagttcatgctatctttccacagtaaaagatgacctaagtcacatttataaggtgatttctgataatgctttgctttctaaatgggcagggggaattggaaatgattggacagatgtccgtgctacaggagctgtaattaagggaaccaatggaaagagtcaaggcgtcattcccttcattaaggttgccaatgatactgcaattgcagtgaatcaggggggcaaacgtaaaggtgctatgtgcgtatatttagaaaactggcacttggattacgaagactttttagaattgcggaagaatacaggagatgagcgtcgtagaactcacgatatcaatacagcaagctggattcctgatctcttctttaagagactagaaaaaaaaggcatgtggacactctttagccccgatgatgtcccaggtttacacgaagcctatgggttagagtttgaaaagctttatgaagaatatgaacgtaaggttgaatctggggaaatccgtctttataaaaaagtagaagccgaagtgctgtggcgtaaaatgttaagcatgctttacgaaacagggcatccttggattacatttaaagatccttcgaatattcgctcaaaccaagatcatgttggcgtcgtacgctgttctaatctatgtacagagattttattgaactgttcggaatcagagactgcagtttgtaatttaggttccataaacttggtagaacatatccgtaatgacaagttagatgaagaaaaattaaaagaaactatctcaatagccatccgtattttggataacgttattgacctgaacttctaccctacaccagaggctaaacaagccaacctaactcacagagctgtggggttgggggttatgggattccaggatgttctttacgagttgaacattagctatgcctcacaagaagctgtcgaattttctgacgagtgctcggagatcatcgcatactacgctattctagcctcgagcttactcgcgaaagaacgaggtacatatgcttcttattcaggatctaagtgggatcgtgggtatctacccttagatactatcgagcttctcaaagaaactcgcggagagcataatgttcttgtagacacatcaagtaaaaaagattggactccagttcgtgatactatccagaaatacggaatgagaaatagccaggtcatggcaattgctcctacagcaacgatctcgaatatcataggggtcacccaatctatagagcccatgtataaacatctctttgtaaagtccaacctttccggagagtttacgatccccaacacctacctgattaaaaaacttaaggaattaggactttgggatgcagaaatgttagatgatctaaaatattttgacggatctctattggaaattgaaaggatccctaatcacttgaaaaagcttttccttacggcatttgaaatcgaacccgagtggattatagagtgtacctctagaagacagaaatggattgatatgggagtttctctaaatctgtatcttgctgagccagatggtaaaaaactctccaatatgtatctcacggcttggaaaaaaggattaaagactacctattatttaagatctcaagctgcaacatcagtagagaaatcatttatagatatcaataaacgcggcattcagcctcgttggatgaaaaataaatcagcgtccacaagtattgtggtcgaaagaaaaacaacccccgtttgttcaatggaagaaggttgcgaatcttgtcaataa

SEQ ID NO: 478 - DNA, 1041 bp, Chlamydia pneumoniae
atggaagcagatattttagatggaaagctcaaacgggttgaggtaagtaaaaaaggattggtgaattgtaatcaagtagatgtcaatcagctagtccctatcaagtataaatgggcttgggaacattacctcaatggatgtgcaaacaactggcttcctactgaagttcctatggcaagagatatcgagttgtggaaatcagatgaactgtctgaagacgaacgcagggtcattttgttaaacctaggatttttcagtaccgcggaaagcctagtcggaaataacatcgttcttgctatcttcaaacatatcacaaaccctgaagcaagacagtatttactgcgtcaagcttttgaggaagccgtacatacacatacatttctctatatttgcgaatctttaggacttgatgaaggcgaagtattcaatgcctataatgaaagagcctcaattagggctaaagatgattttcaaatgacattaacagtcgatgtccttgatcctaatttttctgtacagtcttcagaaggccttgggcagttcattaaaaacttagtaggatactatatcattatggaaggaatcttcttctatagtggttttgtaatgattctctctttccatagacaaaataaaatgacaggaattggagaacagtaccaatacatcctcagagatgaaaccatacatttaaattttggaatcgatcttatcaatggaattaaagaagaaaaccccgaagtttggactacggaactacaagaagaaatcgtcgctcttattgaaaaagctgtagagcttgaaattgagtacgctaaagattgcttacctcgaggaatcttgggattaagatcttcgatgtttatagattacgttcgtcatattgcagatcgtcgtttagagagaattgggttgaagcctatctatcactccagaaatcctttcccttggatgagcgaaaccatggatctgaataaagaaaagaatttctttgaaacccgggttaccgaataccaaaccgctggtaatttaagttggtaa

SEQ ID NO: 479 - DNA, 984 bp, Chlamydia pneumoniae
atggatgcgaaaatgggatatatatttaaagtgatgcgttggattttctgtttcgtggcatgtggtataacttttggatgtaccaattctgggtttcagaatgcaaattcacgtccttgtatactatccatgaatcgcatgattcatgattgtgttgaaagagtcgtggggaataggcttgctaccgctgttttgatcaaaggatccttagaccctcatgcgtatgagatggttaaaggggataaggacaagattgctggaagtgccgtaattttttgtaacggcctgggtcttgagcatacattaagtttgcggaagcatttagaaaataatcccaatagtgtcaagttaggggagcggttgatagcgcgtggggcctttgttcctctagaagaagacggtatttgcgatcctcatatctggatggatctttctatttggaaggaagctgtcatagaaattacagaagttctcattgaaaagttccctgaatggtctgctgaatttaaagcaaatagtgaggaacttgtttgtgaaatgtctattttagattcttgggcgaaacaatgcttgagcacaattcctgaaaatttacggtatcttgtctcaggtcataatgcgttcagttactttacacgtcgctatttagctactcctgaagaagtggcttccggagcatggaggtctcgttgtatttctcctgagggtctatctccagaagctcaaatcagtgttcgtgatattatggcggttgtagattatattaatgagcatgatgtcagtgtggttttccctgaggatactctgaaccaagatgcgttgaaaaaaattgtttcttctctgaagaaaagtcatttagttcgtctagctcaaaaaccattgtatagtgataatgtggacgacaattattttagcacctttaaacataatgtctgccttatcacagaagaattaggaggggtggctcttgaatgtcaaagatga

SEQ ID NO: 480 - DNA, 444 bp, Chlamydia pneumoniae
atgcaaaaccaatacgagcaattactagaatccttagcacccctattaaatacgacacttgctccagataaaaataactcttgtttaatccgtttcagcgatacccatgtccctgtgcaaatagaagaagatggaaattccggagatcttgcagtatcgacactactaggtactcttcctgaaaacgtatttcgcgagcgtattttcaaagctgctctctctgtaaatggctcgttccaatccagcatcaagggaattctaggctacggtgaggtcactcaacagctctatctttcagatatcctgagtatgaactacctaaatggagaaaagttattcgagtatctcaagctcttttctttgcatgctaagatttggatggaatccctaagaacagggaatcttcctgaccttcatgttttgggaatctactacgtcgcgtga

SEQ ID NO: 481 - DNA, 1581 bp, Chlamydia pneumoniae
gtgaatgttttaaaatacacaaaacactcaccctcagcacatgcttggaaacttataggaacctctcctaaacacgggatttatctcccactattttcaatacacacaaaaaatagctgtggaatcggtgaatttttagatctcattcctctgatctcttggtgccaaaaacagggcttcagcgttattcagcttctccctttaaatgatactggtgaagatacgagtccctataacagcatctcttccgtagccctgaatcccctattcctttccctatcctctcttccaaatatcgataccatccctgaagttgccaagaaacttcaagatatgcatgagttatgctcgactccatcagtcagctatactcaagttaaagaaaaaaaatgggcattcttaagagagtactaccaaaaatgttgcaagtcttccctcgaaggaaactcaaatttttctgagtttctagaaagcgagcgctattggctttatccctatgggacctttcgtgcaatcaaacatcatatgcacggagaacctattaataactggccgaagtcgctcacagatcaggagaattttccggacttaactaaaaaattccatgatgaagtcctctttttttcctatctacagtttctctgttaccaacagctctgcgaagtgaaagcctatgcagatcaacaccacgtcctgcttaaaggagacctccctattcttattagcaaggatagctgtgatgtttggtatttccgagactacttttcttcatcaaggtctgtaggagctcctcctgacctctacaattctgaaggacaaaactggcatctgcctatttataatttttcacaacttgccaaagacgactacatttggtggaaagagcgtctgcgatatgctcaaaacttctattccgtctatcgcttagatcatattataggatttttccgtttgtggatttgggattcttcaggaagaggaaggttcattccagacaatcctaaagactatataaagcagggcacggagatcctttctactatgctcggagcctcttctatgttacctatcggagaagatttagggattataccccaagacgtcaaaacgacattaacacacttaggaatctgtggaacccggattccacgatgggaacgcaactgggaaagcgacagtgccttcattcccctaaaagattataatccactttctgtgaccactctctctacccacgactctgatacgtttgcccaatggtggctcaattcacctaaggaagctaagcaatttgctaaatttctacatcttccttttcaaaaaaccctgactacagaaactcaaatagacatcttaaaactttctcatgaatcagcatctatctttcatatcaacctctttaacgattatctcgccctctgccctgatttagtatcaaaaaatctacaaagagaacgcattaatacacctgggacaatttctaaaaagaattggtcgtatcgagttcggccttccttagaagaactcgctattcataaaaaatttaatggttacattgagaagatccttacaggactgtaa

SEQ ID NO: 482 - DNA, 1908 bp, Chlamydia pneumoniae
atgatcccttttactaaaacaatagggttccgtttgtggttggcttgcgccgttgctatcattgcacctctagggatcaacatcgtatggttaaacctagatcaataccgcaccatagtctctgctatttctactgcactgaaagaaaacgctgctttcaaagccaatactctcactcagattgtccctttgaatgtcgatgttctatctctattttctgatgtcttagatttagatgctggtattccagagactccgaacgttctccttagcaatgaaatgcagaaagtattccaagggatctataatgaaatctctttaatcaaggtattcccaaatggagataaaattgttgttgcttctagcattcctgaacacttaggggaaaactataatcacaaaatagacatccctaagaacactccatttttagcagccctaaaacaatctcctaaaaatcaggaagtcttttctgtaatgcaagctaatgtttttgatgcaaaaactcaagaactccaagggatcttatacaccacgttcagtgctgagagcttactcaaagatctcctgataaacaagcaatcctatctcactgtaaaaactgcgatcctttccaaatacggcgttatcttaaaagcttctgatcctgctctccatctccatactgtctaccctgacatgacgaaagaaaaattctgccaagtttttctcaatgatgatccttgccctatagactcagaattaggtcctttaactctctcccctctggatattggagaaaatttctattcttttaaaatcaaagatactgagatttggggctgtattgaaaatgttcccagtatagatattgcagtcctttcctatgctaaaaaagaagagagctttgcgcctttatggcgcagagctcgcatgtacactgcctatttcttttgcattctcttagggagcctcatagcctttattgtagcaagacgattgtcgttacctatcagaaaacttgccactgcgatgatagaatctaggaaaaacaaaaactgcctctatactgacgactccttagggtttgagatcaacagacttggccatatttttaatgctatggtggagaatctccacaaacagcaacacctcgctaagacgaactttgagatgaaagaaaatgcacagaacgctctacatttaggagagcaggctcagcagcgacttcttcctaatactctccccagctatcctcatatagaactcgcaaaagcctatatccctgccattactgtaggtggtgatttctttgatgtttttgttgtaggagagggttcgaaggctcgcctattcctgattgttgctgacgcctcagggaaaggtgttaatgcttgtgggtattcgctatttctaaaaaatatgctcagaacattcctttctcgctcttcgtctcttcaacaggcaatccaagaaacctcacgcttattttataacaatacaaaaaactcagggatgtttgtcactctatgtgtgtactgttatcatcaaacttccaacaccatggaatattattcttgtggacatcctcctgcctgctacctagatcctgatggcgagacttcttggctattccatcctggaatggctttaggcttccttcccgaagttgcgaacatcacttcaaagctatttcatcctaagccagggtctctctttgtcttgtattctgatggtattacagaagcccataataacaataacgacatgtttggagaagagcgcctacaagctgcaattcaaggattgacagggaaaagtgctgctgatgccgtccacaggttgatgttaagtgtaaaaacctttgtcgggaactcccatcaacatgacgacatcaccttattaatattaaaggtattagaatcatga

SEQ ID NO: 483 - DNA, 945 bp, Chlamydia pneumoniae
gtgttctcatacataaaaaaccgaattctttttaatttgctttctctatggattgttttgacactcacgttcctagttatgaaaaccatcccaggagatcctttcaatgacgaaggctgcaatgttctttccgaagaggtcttacaaaccctaaagtctcgatacggtttagataaacctctctatcaacaatacacacaatacctccactccatcgcaaaactagattttgggaactcgttagtttataaagatcgcaaagtaacgaacatcatttcgactgcctttcctatatcagcaatcctaggattgcaaagtctttttctctccataggaggggggatcgctctcggcaccatagcagcattaaaaaaaaagaaacaaagacgctatattctaggcgcctctatactccaaatctcgattcctgcttttatattcgcaacactcttacaatatgtctttgctgtaaaaattcctcttcttcctatcgcctgttggggaagctttactcatactatactcccgactctcgcacttgctgtaactcccatggccttcatcatacagcttacctactcttcagtatccgcagcattaaacaaagactatgtcctactagcctatgcaaaaggactctccccacttaaagtcgttataaaacatattttaccctacgccatattcccaaccatttcttattccgcattcctaactactacagtgattacaggaacctttgctatcgaaaatatcttctgtattcctggattaggtaaatggtttatttgtagtatcaaacaacgagactacccagtagcccttggcttatccgtattttatggaaccttatttatgctctcttctttactttctgacctgattcaatccattatagatccgcaaatccgttatgcgcacggaaaggaaaaaaaaagaaaataa

SEQ ID NO: 484 - DNA, 3723 bp, Chlamydia pneumoniae
ttgacctggataccccttcactgtcattctcaatactctgttcttgatgcaatgagctccatcaaagatttcgttgcgaaaggtcaggaatttggaattcccgctctggctctaacagaccatgggaatctttatggagctgttgatttctataaagaatgcactcaaaaagggatccaacccatcattggttgcgagtgttatattgctccaggatcacgtttcgataagaaaaaagagaagcgtagtcgtgcagcacaccatctcattttattatgtaaaaatgaacaagggtaccgcaacctttgtattttaacctccctagcatttactgagggtttctattactttcctcggatagacaaggatcttttgagacagtactctgaaggcttaatctgtttatctggttgtttatctagttctgtttcagatgctgccttaaaatctccggaagctctgcttcttgaattgcaatggtttcaagacctattcaaagatgattatttcacagaagtacaactacacaagatgtccgaagagagcattgcaggctttaaagaggaatggttaaagcaagaatattactctctcattgaaaaacagatcaaagtcaatactgcagtgttagaagcaagtaagcgcttaggcattcctactgtagctacgaatgacatccattacatcaatgcaaacgattggcaagctcatgaaatcctgttgaatgtccaatctggggagactgtgcggattgcgaaacagaatactcatatccccaatcctaaacgaaaggtctatcgcagtcgcgagtactattttaaatcccctgcgcaaatggcagagttatttaaagatattcctgaggtcatttccaacacattagaagttgccaaacggtgtgattttacttttgatttttccaagaaacactaccctatctatgtccctgaatctttaaaaaccttaaacagctacacggaggaagaccgttatcaagcttctgcagtcttcttaaaacagctagctgaagaagctttgcctaagaaatactcttctgaagttcttgctcatattgctaagaaatttccacatcgggaccctatcgatattgtcaaagaaaggatggacatggagatggccatcatcattcctaaaggaatgtgtgactatcttttgattgtttgggacattattcattgggccaaagcaaatggcattcctgtaggccctggaagaggttcaggagctggatccgtattactatttttgttagggatcacagaaatcgagcccatacgatttgatttattctttgagagatttatcaatcctgagcgtttgtcttacccagatattgacatcgatatttgcatggcaggacgtgaacgtgtcattaattatgcaattgagcgtcatggcaaagataatgtagctcaaatcattacttttggaactatgaaagccaaaatggctgtcaaagatgtgggaagaactttagacatggccttatctaaagtgaaccacattgcgaaacatattccagatttaaatactacgttgtctaaagctttagaaacagatcctgacctacatcagctctatattaacgatgccgaatctgcacaagtgattgatatggcgctttgcttagaaggctccatacggaatacaggggttcatgctgctggtgtgattatctgtggagaccagctgaccaatcacattccgatttgtatttctaaagactccacaatgattacaacacaatactctatgaaacccgtggagagtgttggaatgcttaaagtcgacttattagggctcaagactttaaccagtatcaatattgcaatgtctgcaattgaaaagaaaacaggacaatcgctagctatggcgacactgcctttggatgatgccaccacattttctcttttacatcagggaaagactatggggatatttcaaatggaatccaaggggatgcaagaattagcaaaaaacctacgccctgacctctttgaggaaatcattgctatgggtgctttataccgcccaggccctatggatatgattccttcttttattaaccgcaagcatggcaaagaaattatagaatacgaccatccccttatggaatccattcttaaggaaacctatggaattatggtctaccaagagcaagtcatgcagattgctggtgcattagctagttattctcttggagaaggtgatgtattacgacgtgccatggggaagaaagacttccaacagatggagcaggagcgcgaaaagttctgtaaacgcgcctgcaataacggcatagatcctgagttagcgactgtcatctttgataagatggaaaaatttgctgcctacggctttaacaaatctcatgctgctgcctatggcttgattacttatacaacggcgtatctcaaagcaaattatcctaaagagtggcttgcggccttacttacctgtgattctgacgatattgagaagataggaaaactgattcgagaagctcagagtatgggcattccgattcttcctcctcatatcaatgtctctagcaatcactttgtagctactgatgaaggcatacgctttgcgatgggagctattaaagggattgggcgtggtttaattgagagcattgtagaagagagagatcatcatggtccttatgagagcatccgcgactttatccagaggtctgatttaaaaaaagtttcgaaaaaaagtatagaaagtttaatcgatgcgggttgttttgattgctttgattctaaccgagatttgctgttagcctctgtagagcccctctatgaagctattgccaaagacaagaaagaggctgcatctggtgtgatgacgttctttactttaggagctatggatcgaaaaaatgaagtccccatttgtcttcctaaagacattccgactcgctctaagaaagaacttttaaaaaaagaaaaagagctcttagggatttaccttacagagcaccctatggataccgtgcgagatcatctttctcgtctttctgtagttcttgctggagaatttgaaaatctcccgcatggttctgtagtccgcaccgtgtttattattgataaagtaacgactaaaatttcatcaaaagcgcaaaagaagtttgctgtccttcgtgttagtgatggcatcgattcttatgaactgccgatctggccagatatgtatgaagaacaacaagaacttctagaagaagatcgtcttatctatgctattcttgttttagataagcgcagtgattctctacgtatttcttgtcgctggatgaaagatctttctattgttaatgaaaacatcatttatgagtgtgatcaagcttttgatagaataaaaaatcaggtgcaaaaaatgtcatttacaatgtcaacctctggcaaagaaactaaagctaaagggaataagcctaatgagaatgggcatacacaagctttagctcctgtgactctatctttagatctcaatgaactccgtcatagtcatctatgtatcttaaagaagattgtgcaaaagcaccctggctcacggacattagttttagtttttactcaagataacgaaagagttgcctcgatgtctcctgacgacgcgtatttcgtttgtgaagatattgaagaactccgtcaagaacttgtgactgcagaccttcctgtgcgtgtaattactgtttga

SEQ ID NO: 485 - DNA, 1731 bp, Chlamydia pneumoniae
atgacagattttcctactcacttcaaaggacccaaacttaaccccattaaagtaaatccaaacttttttgagaggaatcctaaagtcgcaagggtactgcaaattacagccgtagtcttaggaatcattgccctcttatccggtatagtactcattataggcacccctctcggagctcctataagtatgatcctcggcggatgtcttttagcttctggaggcgccttatttgttggtggtacgattgctacgatattgcaagctagaaatagttataagaaggccgtgaaccaaaagaaactctcagagcctttgatggaacgccccgaattgaaagccttagattattccctagatctgaaagaggtatgggacctacatcattctgttgtcaaacatcttaaaaaattagacctgaatctttccaaaacccaaagggaagttctaaatcaaatcaaaattgatgatgagggaccctccctaggggaatgcgccgctatgatttcagaaaactacgacgcatgcttaaagatgctcgcgtatcgtgaggagctcctgaaagaacaaacccaataccaagagacacgattcaatcagaacctcactcatagaaataaagttttgctctccatcctctcaaggatcacggacaatatttctaaagcgggcggggtcttttctttgaaattttccacgctaagctcgcggatgtcacgaattcataccaccaccactgtgattctggctttaagtgccgttgtttctgtcatggtcgtagcagctctaattccaggtggcattttagcactacctatacttttggctgttgctatttctgcaggagtgattgtcaccggactttcctatctagttcgtcagattttaagtaacaccaagcgtaatcgtcaggatttttataaagattttgtaaaaaatgtagatatagagcttcttaaccaaacggtaactttacagcgattcctctttgaaatgctcaaaggtgttctgaaagaagaagaagaagtctccttagaaggtcaagattggtatacacaatacataaccaatgcacccatagaaaaaagattgatcgaagagatcagagttacctacaaagagatcgatgctcagaccaaaaaaatgaagacagacttggagttcttagaaaatgaggtgcgttccgggagactgtctgtagcgtccccgtcggaagatccaagtgaaactcctatttttactcaaggtaaggagtttgcaaagttacgtcgccaaacctctcagaatatatccacgatttatggtccggacaatgaaaatattgatcccgaattttccttaccctggatgcctaaaaaagaagaagaaatagaccatagcttagaacctgttacaaagttggaacccggttcaagagaagagttgttgttggtagagggggtcaacccaaccttaagagaactcaatatgagaattgcacttctacaacaacaactatcaagtgtccgaaaatggagacaccctcgaggggaacattacgggaatgttatctattcagatacagaactcgatcgtattcagatgctagaaggcgcattttataatcacctcagggaagctcaagaggaaatcacccagtctctcggagaccttgttgacattcaaaaccgtattttagggatcatagttgaaggggactcagattcaagaacagaagaagagcctcaggaatag

SEQ ID NO: 486 - DNA, 4224 bp, Chlamydia pneumoniae
atgaaatattctttaccttggctacttacctcttcggctttagttttctccctacatccactaatggctgctaacacggatctctcatcatccgataactatgaaaatggtagtagtggtagcgcagcattcactgccaaggaaacttcggatgcttcaggaactacctacactctcactagcgatgtttctattacgaatgtatctgcaattactcctgcagataaaagctgttttacaaacacaggaggagcattgagttttgttggagctgatcactcattggttctgcaaaccatagcgcttacgcatgatggtgctgcaattaacaataccaacacagctctttctttctcaggattctcgtcactcttaatcgactcagctccagcaacaggaacttcgggcggcaagggtgctatttgtgtgacaaatacagagggaggtactgcgacttttactgacaatgccagtgtcaccctccaaaaaaatacttcagaaaaagatggagctgcagtttctgcctacagcatcgatcttgctaagactacgacagcagctctcttagatcaaaatactagcacaaaaaatggcggggccctctgtagtacagcaaacactacagtccaaggaaactcaggaacggtgaccttctcctcaaatactgctacagataaaggtggggggatctactcaaaagaaaaggatagcacgctagatgccaatacaggagtcgttaccttcaaatctaatactgcaaagacggggggtgcttggagctctgatgacaatcttgctcttaccggcaacactcaagtactttttcaggaaaataaaacaaccggctcagcagcacaggcaaataacccggaaggttgtggtggggcaatctgttgttatcttgctacagcaacagacaaaactggattagccatttctcagaatcaagaaatgagcttcactagtaatacaacaactgcgaatggtggagcgatctacgctactaaatgtactctggatggaaacacaactcttaccttcgatcagaatactgcgacagcaggatgtggcggagctatctatacagaaactgaagatttttctcttaagggaagtacgggaaccgtgaccttcagcacaaatacagcaaagacaggcggcgccttatattctaaaggaaacagctcgctgactggaaataccaacctgctcttttcagggaacaaagctacgggcccgagtaattcttcagcaaatcaagagggttgcggtggggcaatcctagcctttattgattcaggatccgtaagcgataaaacaggactatcgattgcaaacaaccaagaagtcagcctcactagtaatgctgcaacagtaagtggtggtgcgatctatgctaccaaatgtactctaactggaaacggctccctgacctttgacggcaatactgctggaacttcaggaggggcgatctatacagaaactgaagattttactcttacaggaagtacaggaaccgtgaccttcagcacaaatacagcaaagacaggcggcgccttatattctaaaggcaacaactctctgtctggtaataccaacctgctcttttcagggaacaaagctacgggcccgagtaattcttcagcaaatcaagagggttgcggtggggcaatcctatcgtttcttgagtcagcatctgtaagtactaaaaaaggactctggattgaagataacgaaaacgtgagtctctctggtaatactgcaacagtaagtggcggtgcgatctatgcgaccaagtgtgctctgcatggaaacacgactcttacctttgatggcaatactgccgaaactgcaggaggagcgatctatacagaaaccgaagattttactcttacgggaagtacgggaaccgtgaccttcagcacaaatacagcaaagacagcaggggctctacatactaaaggaaatacttcctttaccaaaaataaggctcttgtattttctggaaattcagcaacagcaacagcaacaacaactacagatcaagaaggttgtggtggagcgatcctctgtaatatctcagagtctgacatagctacaaaaagcttaactcttactgaaaatgagagtttaagtttcattaacaatacggcaaaaagaagtggtggtggtatttatgctcctaagtgtgtaatctcaggcagtgaatccataaactttgatggcaatactgctgaaacttcgggaggagcgatttattcgaaaaacctttcgattacagctaacggtcctgtctcctttaccaataattctggaggcaagggaggcgccatttatatagccgatagcggagaactttccttagaggctattgatggggatattactttctcagggaaccgagcgactgagggaacttcaactcccaactcgatccatttaggtgcaggggctaagatcactaagcttgcagcagctcctggtcatacgatttatttttatgatcctattacgatggaagctcctgcatctggaggaacaatagaggagttagtcatcaatcctgttgtcaaagctattgttcctcctccccaaccaaaaaatggtcctatagcttcagtgcctgtagtccctgtagcacctgcaaacccaaacacgggaactatagtattttcttctggaaaactccccagtcaagatgcctcgattcctgcaaatactaccaccatactgaaccagaagatcaacttagcaggaggaaatgtcgttttaaaagaaggagccaccctacaagtatattccttcacacagcagcctgattctacagtattcatggatgcaggaacgaccttagagaccacgacaactaacaatacagatggcagcatcgatctaaagaatctctctgtaaatctggatgctttagatggcaagcgtatgataacgattgccgtaaacagcacaagtgggggattaaaaatctcaggggatctgaaattccataacaatgaaggaagtttctatgacaatcctgggttgaaagcaaacttaaatcttcctttcttagatctttcttctacttcaggaactgtaaatttagacgacttcaatccgattccttctagcatggctgctccggattatgggtatcaagggagttggactctggttcctaaagtaggagctggagggaaggtgactttggtcgcggaatggcaagcgttaggatacactcctaaaccagagcttcgtgcgactttagttcctaatagcctttggaatgcttatgtaaacatccattctatacagcaggagatcgccactgcgatgtcggacgctccctcacatccagggatttggattggaggtattggcaacgccttccatcaagacaagcaaaaggaaaatgcaggattccgtttgatttccagaggttatattgttggtggcagcatgaccacccctcaagaatatacctttgctgttgcattcagccaactctttggcaaatctaaggattacgtagtctcggatattaaatctcaagtctatgcaggatctctctgtgctcagagctcttatgtcattcccctgcatagctcattacgtcgccacgtcctctctaaggtccttccagagctcccaggagaaactccccttgttctccatggtcaagtttcctatggaagaaaccaccataatatgacgacaaagcttgcgaacaacacacaagggaaatcagactgggacagccatagcttcgctgttgaagtcggtggttctcttcctgtagatctaaactacagataccttaccagctactctccctatgtgaaactccaagttgtgagtgtaaatcaaaaaggattccaagaggttgctgctgatccacgtatctttgacgctagccatctggtcaacgtgtctatccctatgggactcaccttcaaacacgaatcagcaaagccccccagtgctttgcttcttactttaggttacgctgtagatgcttaccgggatcaccctcactgcctgacctccttaacaaatggcacctcgtggtctacgtttgctacaaacttatcacgacaagctttctttgctgaggcttctggacatctgaagttacttcatggtcttgactgcttcgcttctggaagttgtgaactgcgcagctcctcaagaagctataatgcaaactgtggaactcgttattctttctaa

SEQ ID NO: 487 - DNA, 804 bp, Chlamydia pneumoniae
atgggcaattcaggtttctatttacaagatactcaaaacactattttcgcagataacattcgtcttggtcaaatgaccacagttcttaaaaaagacgaggttattataggcacagatacaactccaacagtaacaaaatttagtggcgataagggaattgtaattactacagactcaaccataacaccatctagcactactttttctttggatatggaagctgtaatcaaagaagtaacagataaaatcttaactcaaattgaagatgagttagtcaaagacattataaaaaacataactcaaagtctaatagaagaagtaattaagaaaatacacattgatccttctttctcatattctagagcatttaaagatgttaatataactaataaaattcagtgcaatggtctatttacaaaagaaaatatagggaatttagacggaggaacagaaatagcttcgtcttcagtaacacctgataatgctaatagtatgttcttaatttgtgcggatattatagccacacgcatggaaggaacagtggccttggcgttagttaaagaaggagatttatctccttgctctattagttatggatactccgctggatatccgaatataatttcactaagagcaaccgtcggaaacaaaacaactgctccagttaaattctctttgagagcaggagggatggatagtggtgttgtgtgggtaaatgctatgccaaatggagaaaaaattttaggagttgacgcagtttcgaagattactatcttagaagtaaaaccacaaacaaatggttaa

SEQ ID NO: 488 - DNA, 306 bp, Chlamydia pneumoniae
atgaataacagacaaaacactaatgactttatcagaattgtgaaggatgttgaaaaggcgtttccagaactagatatcaaagtaaaaatagataaagaaaaagttacttttttgacttctccaacagagctttatcacaaaagtatatctgtcatactcaatttactaaacagcattgaatcatctctagaccttttcccagactctccagtagttgaagaattagaaaaaaataatcttaagctcaaaaaagctctgatcatgctaattctatcaagaaaagacatgttctcaaaaacagaataa

SEQ ID NO: 489 - DNA, 806 bp, Chlamydia pneumoniae
gtgaaaacaatagcattttgctcatttaaaggagggactggtaaaactaccttgtctctcaatgttggttgtaatttagcccaatatagcaacaaaaaggttttgcttgtggatttagatccacaagcaaaccttactacaggtcttggtgtacaatcttgttatgaatctaatttgaacgacatttttagaagttcaggaaacgtaagggatatcattcaagatacgaagatagaaaacttacacatagtaccttctagtattctcatagaggagtttcgagaatttaatagaaatagtgtactggatacaagtcatttgcgttcatctttacaacttattgaatccaattatgatctgtgtattttagacactccaccaagtctggggacgctcaccgaagaagcctttattgcatcagatcatttgattgtttgtcttactcctgaaccattttccatattaggattacagaaaatcaaagagttttgttcagtgttacctaaaaagaaagacttatcagtgttaggaatagttttttctttttgggacggaaggaattcaacaaattcaacctacttgaacattatagaatctatctacgaagggaaagtgttatctagtaaagtacgaagagacataacattaagcagatctcttttaaaagaaacatccatagctaacgcataccctaattctagagcaagtcatgacatactgcgtctaacaaaggagatagaagataaactattcaataaagaaatgtctgcccaggaagtgttgtgagtaagttagtcaaagaagca

SEQ ID NO: 490 - protein, 293 aa, Chlamydia pneumoniae
MSKHTSESRIAQDMLERYSGSSVKQFCPYLLLTNFSYYIQTFAKLHGVPVFEGSMFSAAHAPHLKTSILDFKLGSPGAALTIDLCSFLPDLKAALMLGMCGGLRSHYQVGDYFVPVASIRGEGTSDAYFPPEVPALANFVVQKATTEVLEDKKANYHIGITHTTNIRFWEFNKKFRKKLYETKAQSAEMECATLFAAGYRRNLPIGALLLISDLPLRKEGIKTKSSGNFIFNTYTEDHILTGQEVIENLEKVMLKRAASDHKKDQQYRGLPHMEVGEADDTMASGSETSDSDY

SEQ ID NO: 491 - protein, 394 aa, Chlamydia pneumoniae
MSKETFQRNKPHINIGTIGHVDHGKTTLTAAITRALSGDGLASFRDYSSIDNTPEEKARGITINASHVEYETPNRHYAHVDCPGHADYVKNMITGAAQMDGAILVVSATDGAMPQTKEHILLARQVGVPYIVVFLNKVDMISQEDAELIDLVEMELSELLEEKGYKGCPIIRGSALKALEGDANYIEKVRELMQAVDDNIPTPEREIDKPFLMPIEDVFSISGRGTVVTGRIERGIVKVSDKVQLVGLGETKETIVTGVEMFRKELPEGRAGENVGLLLRGIGKNDVERGMVVCQPNSVKPHTKFKSAVYVLQKEEGGRHKPFFSGYRPQFFFRTTDVTGVVTLPEGTEMVMPGDNVELDVELIGTVALEEGMRFAIREGGRTIGAGTISKINA

SEQ ID NO: 492 - protein, 560 aa, Chlamydia pneumoniae
  VARIANT (1)...(560): Xaa = Any Amino Acid
MPQKVLITSALPYANGPLHFGHIAGVYLPADVYARFRRLLGDDVLYICGSDEFGIAITLNADREGLGYQEYVDMYHKLHKDTFEKLGFALDFFSRTTNPFHAELVQDFYSQLKASGLIENRISEQLYSEQEQRFLADRYVEGTCPRCGFDHARGDECQSCGADYEAIDLIGPKSKISGVELVKKETEHSYFLLDRMKDALLSFIQGCYLPDHVRKFVVDYIEHVRSRAITRDLSWGIPVPDFPGKVFYVWFDAPIGYISGTMEWAASQGNPDEWKRFWLEDGVEYVQFIGKDNLPFHSVVFPAMELGQKLDYKKVDALVVSEFYLLEGRQFSKSEGNYVDMDKFLSSYSLDKLRYVLAATAPETSDSEFTFLDFKTRCNSELVGKFGNFINRVLAFAEKNHYDKLSYHSVVLEDSDRAFLEEARQLVRDAEKCYREYSLRKATSVIMSLAALGNVYFNQQAPWKLLKEGTRERVEAILFCACYCQKLLALISYPIIPESAVAIWEMISPKSLENCNLDTMYARDLWKEEILDVINEEFHLKSPRLLFTTVETXXXXFXXX

SEQ ID NO: 493 - protein, 97 aa, Chlamydia pneumoniae
MIKKDRFTNEKLNKLFDSPFSLVNYAIKQAKIKIAKGDVRSSNVAIETLVLLDREGIQPEFTEEIVVTASPTVERKRSEHTNSRKKDPSAYTWSDVK

SEQ ID NO: 494 - protein, 205 aa, Chlamydia pneumoniae
MNKILVDSPFSPDHQKCCPKLFTISAPAGVGKTTLVRMLEQEFSSAFAETISVTTRKPREGEVPGKDYHFVSHEEFQRLLDRQALLEWVFLFGECYGTSMLEIERIWSLGKHAVAVIDIQGALFIRSRMPSVSIFIAPPSQEELERRLASRGSEEGSQRKERLEHSLIELAAANQFDYVIINDDLNQAYRVLKSIFIAEEHRNIL

SEQ ID NO: 495 - protein, 602 aa, Chlamydia pneumoniae
MKEYKIENIRNFSIIAHIDHGKSTIADRLLESTSTVEEREMREQLLDSMDLERERGITIKAHPVTMTYLYEGEVYQLNLIDTPGHVDFSYEVSRSLSACEGALLIVDAAQGVQAQSLANVYLALERDLEIIPVLNKIDLPAADPVRIAQQIEDYIGLDTTNIIACSAKTGQGIPAILKAIIDLVPPPKAPAETELKALVFDSHYDPYVGIMVYVRIISGELKKGDRITFMAAKGSSFEVLGIGAFLPKATFIEGSLRPGQVGFFIANLKKVKDVKIGDTVTKTKHPAKTPLEGFKEINPVVFAGIYPIDSSDFDTLKDALGRLQLNDSALTIEQESSHSLGFGFRCGFLGLLHLEIIFERIIREFDLDIIATAPSVIYKVVLKNGKVLDIDNPSGYPDPAIIEHVEEPWVHVNIITPQEYLSNIMNLCLDKRGICVKTEMLDQHRLVLAYELPLNEIVSDFNDKLKSVTKGYGSFDYRLGDYRKGSIIKLEVLINEEPIDAFSCLVHRDKAESRGRSICEKLVDVIPQQLFKIPIQAAINKKVIARETIRALSKNVTAKCYGGDITRKRKLWEKQKKGKKRMKEFGKVSIPNTAFIEVLKLD

SEQ ID NO: 496 - protein, 324 aa, Chlamydia pneumoniae
MELLPHEKQVVEYEKAIAEFKEKNKKNSLLSSSEIQKLEKRLDKLKEKIYSDLTPWERVQICRHPSRPRTVNYIEGMCEEFVELCGDRTFRDDPAVVGGFVKIQGQRFVLIGQEKGCDTASRLHRNFGMLCPEGFRKALRLGKLAEKFGLPVVFLVDTPGAYPGLTAEERGQGWAIAKNLFELSRLATPVIIVVIGEGCSGGALGMAVGDSVAMLEHSYYSVISPEGCASILWKDPKKNSEAASMLKMHGENLKQFGIIDTVIKEPIGGAHHDPALVYSNVREFIIQEWLRLKDLAIEELLEKRYEKFRSIGLYETTSESGPEA

SEQ ID NO: 497 - protein, 659 aa, Chlamydia pneumoniae
MKLLLKAVLRHKNHLVILGCSLLAILGLTFSSQMEIFSLGMIAKTGPDAFLLFGRKESGKLVKVSELSQKDILENWQAISKDSETLTVSDATTYIAEHGKSTASLTSKLSKFVRNYIDVSRFRGLAIFLICVAIFKAVTLFFQRFLGQVVAIRVSRDLRQDYFKALQQLPMTFFHDHDIGNLSNRVMTDSASIALAVNSLMINYIQAPITFILTLGVCLSISWKFSILICVAFPIFILPIVVIARKIKNLAKRIQKSQDSFSSVLYDFLAGVMTVKVFRTEKFAFTKYCEHNNKISALEEKSAAYGLLPRPLLHTIASLFFAFVVVIGIYKFAIPPEELIVFCGLLYLIYDPIKKFGDENTSIMRGCAAAERFYEVLNHPDLHSQKEREIEFLGLSNTITFENVSFGYQEDKHILKNLSFTLHKGEALGIVGPTGSGKTTLVKLLPRLYEVSQGKILIDSLPITEYNKGSLRNHIACVLQNPFLFYDTVWNNLTCGKDMEEEAVLEALKRAYADEFILKLPKGVHSVLEESGKNLSGGQQQRLAIARALLKNASILILDEATSALDAISENYIKNIIGELKGQCTQIIIAHKLTTLEHVDRVLYIENGQKIAEGTKEELLQTCPEFLKMWELSGTKEYNRVFVPDHKLVANPTDMAITT

SEQ ID NO: 498 - protein, 411 aa, Chlamydia pneumoniae
MIPTMLMFFIICFTLCSGFISLSQIALFSLPTSLISHYKRSKSKKQQRVATLLLHPHHLLITLIFCDIGLNIAIQNCFAILFGDAASWWFTVGLPLAITLILGEILPKAVALPFNTQIASSVAPLILCVTKIFKPLLHWGIVGINYVVQWILSKQQIDIIQPQELKEVLQSCKDFGVVNQEESRLLYGYLSLSDCSVKERMQPRQDILFYDIQTPLENLYLLFSKQHCSRVPICNDNLQNLLGICTARSLLLHDKPLQSSDDLLPLLKKPYYMPETISAKMALCQMAAEDETLGMIIDEYGSIEGLITQEDLFEIVAGEIVDQRDNKILYTTSGADVIIASGTLELREFSEIFDINLPTNNNIATIGGWLIEQIGTIPTTGMKLSWNNLLFQVLDAAPNRIRRVYIRKLYD

SEQ ID NO: 499 - protein, 404 aa, Chlamydia pneumoniae
MTNSALFWIGVNIICIVLQGFYSMMEMACVSFNRVRLQYYLTKDHKKARYINFLIRRPYRLFGTVMLGVNIALQVGSESSRNCYRALGITPDYAPFTQIFIVVIFAELLPLTISRKIPEKLALWGAPILYYSHYIFYPLIQLIGSLTEGLYYLLNIRKEKLNSTLSRDEFQKALETHHEEQDFNTIATNIFSLSATCADQVCQPLEQVTMLPSSANVKDFCRTIKNTDINFIPVYHKARKNVIGIAHPKDFVNKALDEPLINNLHSPWFITAKSKLIRILKEFRDNRSSVAVVLNASGEPIGILSLNAIFKILFNTTNIAHLKPKTISVIERTFPGNSRIKDLQKELDIQFPQYPVETLAQLVLQLLDSPAEVGTSVIINNLLLEVKEMSLSGIKTVSIKNLLS

SEQ ID NO: 500 - protein, 543 aa, Chlamydia pneumoniae
MFGSESLRYQLLIQDFAKVSEEGIGLLESKEYSLLQAKLVLRALAQNSSFDDWFRSFKKCQISYPELAHDRDVLEEFGIQVLREGIENPSVTVRAVSVLAIGLARDFRLVPLLLQSCNDDSAIVRSLALQVAVNYGSESLKKAIVELARNDDSIHVRITAYQVVALLQIEELLPFLRERAENKLVDSVERREAWKACLELSSQFLETGVAKDDIDQALFTCEVLRNGMLPETTEIFTELLSVEHPEVQESLLLSALAWSHQLQNHKEFLSKVRHVMCTSPFAKVRFQAAALLHLHGDPLGRDSLVEGLRSPQPLVCEAASAALCSLGIHGVPLAKEHLESLSSRKAAANLSILLLVSREDIERAGDVIARYLSNPEMCWAIEYFLWDAQWNLRGDTFPLYSDMIKREIGRKLIRLLAVARYSQAKAVTATFLSGQQAQGWSFFSGMFWEEGDVKTSEDLVTDACFAAKLEGALASLCQKKDQASLQRVSQLYNDSRWQDKLAILESVAFSENLDAVPFLLDCCHHEAPSLRSAAAGALFSIFK

SEQ ID NO: 501 - protein, 103 aa, Chlamydia pneumoniae
MSFKRFLQQIPVRICLLIIYLYQWLISPLLGSCCRFFPSCSHYAEQALKSHGFLMGCWLSIKRIGKCGPWHPGGIDMVPKTALQEVLEPYQEIDGGDSSHFSE

SEQ ID NO: 502 - protein, 362 aa, Chlamydia pneumoniae
MAFKRKTRWLWQVLILSVGLNMLFLLLFYSAIFRKDIYKLHLFSGPLIAKSSRKVYLSEDFLNEISQASLDDLISLFKDERYMYGRPIKLWALSVAIASHHIDITPVLSKPLTYTELKGSSVRWLLPNIDLKDFPVILDYLRCHKYPYTSKGLFLLIEKMVQEGWVDEDCLYHFCSTPEFLYLRTLLVGADVQASSVASLARMVIRCGSERFFHFCNEESRTSMISATQRQKVLKSYLDCEESLAALLLLVHDSDVVLHEFCDEDLEKVIRLMPQESPYSQNFFSRLQHSPRRELACMSTQRVEAPRVQEDQDEEYVVQDGDSLWLIAKRFGIPMDKIIQKNGLNHHRLFPGKVLKLPAKQS

SEQ ID NO: 503 - protein, 582 aa, Chlamydia pneumoniae
MSGKKDGVRGMIFVPLSILVLIFLPLPQILLDFGLCISFALSLLTVCWVFTLNSSNSAKLFPPFFLYLCLLRLGLNLASTRWIVSSGTASSLIVSLGSFFSLGSLWAATFACLLLFFVNFLMVSKGSERIAEVRSRFFLEALPAKQMALDSDLVSGRASYKAVKKQKNALIEEGDFFSAMEGVFRFVKGDAIISCILLLVNVVSVTCLYYTSGYALEQMWFTVLGDALVSQVPALLTSCAAATLISKIDKEESLLNYLFEYYKQLRQHFRVVSLLIFSLCCIPSSPKFPIVLLASLLWLAYRKEEPASEDSCIERAFSYVEGACPKEQESQFYQVYRAASEEVFEDLGVRLPVLTSLRIEERPWLRVFGQNVYLDEMTPEAVLPFLRNIAHEALNAEVVQKYLEESERVFGIAVEDIVPKKISLSSLVVLSRLLVRERVSLKLFPKILEAVAVYQNSGDSLEILAEKVRKSLGYWIGRSLWDQKQTLEVITIDFHVEELINSSYSKSNPVMQENVIRRVDSLLERSVFKDFRAIVTSCETRFEMKKMLDPHFPDLLVLSHDELPKEIPISFLGIVSDEVLVP

SEQ ID NO: 504 - protein, 435 aa, Chlamydia pneumoniae
MFSRWITLFLLFISLTGCSSYSSKHKQSLIIPIHDDPVAFSPEQAKRAMDLSIAQLLFDGLTRETHRESNDLELAIASRYTVSEDFCSYTFFIKDSALWSDGTPITSEDIRNAWEYAQENSPHIQIFQGLNFSTPSSNAITIHLDSPNPDFPKLLAFPAFAIFKPENPKLFSGPYTLVEYFPGHNIHLKKNPNYYDYHCVSINSIKLLIIPDIYTAIHLLNRGKVDWVGQPWHQGIPWELHKQSQYHYYTYPVEGAFWLCLNTKSPHLNDLQNRHRLATCIDKRSIIEEALQGTQQPAETLSRGAPQPNQYKKQKPLTPQEKLVLTYPSDILRCQRIAEILKEQWKAAGIDLILEGLEYHLFVNKRKVQDYAIATQTGVAYYPGANLISEEDKLLQNFEIIPIYYLSYDYLTQDFIEGVIYNASGAVDLKYTYFP

SEQ ID NO: 505 - protein, 171 aa, Chlamydia pneumoniae
MKKLLFSTFLLVLGSTSAAHANLGYVNLKRCLEESDLGKKETEELEAMKQQFVKNAEKIEEELTSIYNKLQDEDYMESLSDSASEELRKKFEDLSGEYNAYQSQYYQSINQSNVKRIQKLIQEVKIAAESVRSKEKLEAILNEEAVLAIAPGTDKTTEIIAILNESFKKQN

SEQ ID NO: 506 - protein, 360 aa, Chlamydia pneumoniae
MSEAPVYTLKQLAELLQVEVQGNIETPISGVEDISQAQPHHIAFLDNEKYSSFLKNTKAGAIILSRSQAMQHAHLKKNFLITNESPSLTFQKCIELFIEPVTSGFPGIHPTAVIHPTARIEKNVTIEPYVVISQHAHIGSDTYIGAGSVIGAHSVLGANCLIHPKVVIRERVLMGNRVVVQPGAVLGSCGFGYITNAFGHHKPLKHLGYVIVGDDVEIGANTTIDRGRFKNTVIHEGTKIDNQVQVAHHVEIGKHSIIVAQAGIAGSTKIGEHVIIGGQTGITGHISIADHVIMIAQTGVTKSITSPGIYGGAPARPYQETHRLIAKIRNLPKTEERLSKLEKQVRDLSTPSLAEIPSEI

SEQ ID NO: 507 - protein, 399 aa, Chlamydia pneumoniae
MAASGGTGGLGGTQGVNLAAVEAAAAKADAAEVVASQEGSEMNMIQQSQDLTNPAAATRTKKKEEKFQTLESRKKGEAGKAEKKSESTEEKPDTDLADKYASGNSEISGQELRGLRDAIGDDASPEDILALVQEKIKDPALQSTALDYLVQTTPPSQGKLKEALIQARNTHTEQFGRTAIGAKNILFASQEYADQLNVSPSGLRSLYLEVTGDTHTCDQLLSMLQDRYTYQDMAIVSSFLMKGMATELKRQGPYVPSAQLQVLMTETRNLQAVLTSYDYFESRVPILLDSLKAEGIQTPSDLNFVKVAESYHKIINDKFPTASKVEREVRNLIGDDVDSVTGVLNLFFSALRQTSSRLFSSADKRQQLGAMIANALDAVNINNEDYPKASDFPKPYPWS

SEQ ID NO: 508 - protein, 224 aa, Chlamydia pneumoniae; identical to SEQ ID NO: 397

SEQ ID NO: 509 - protein, 246 aa, Chlamydia pneumoniae
MKITTVKTPKIYPYDDLYSILESSLPKLNERSIVVITSKIVSLCEGAVVELEKVSKDELIKQEADAYVFVEKYGIYLTKKWGILIPSAGIDESNVEGYFVLYPRDFLLSVNTLGDWLRNFYHLEHCGIIISDSHTTPLRRGTMGLGLCWNGFFPLYNYVGKPDCFGRALKMTYSNLLDGLSAAAVLCMGEGDEQTPIAIIEEAPKITFHSSPTTLQDMSTLAIAEDEDLYGPLLQSMAWETPAPTS

SEQ ID NO: 510 - protein, 353 aa, Chlamydia pneumoniae
MNKRQKDKLKICVIISTLILVGIFARAPRGDTFKTFLKSEEAIIYSNQCNEDMRKILCDAIEHADEEIFLRIYNLSEPKIQQSLTRQAQAKNKVTIYYQKFKIPQILKQASNVTLVEQPPAGRKLMHQKALSIDKKDAWLGSANYTNLSLRLDNNLILGMHSSELCDLIITNTSGDFSIKDQTGKYFVLPQDRKIAIQAVLEKIQTAQKTIQVAMFALTHSEIIQALHQAKQRGIHVDIIIDRSHSKLTFKQLRQLNINKDFVSINTAPCTLHHKFAVIDNKTLLAGSINWSKGRFSLNDESLIILENLTKQQNQKLRMIWKDLAKHSEHPTVDDEEKEIIEKSLPVEEQEAA

SEQ ID NO: 511 - protein, 186 aa, Chlamydia pneumoniae
MALNFKINRQIRAPKVRLIGSAGEQLGILAIKDALDLAREAGLDLVEVASNSEPPVCKIMDYGKYRYGLTKKEKDSKKAQHQVRIKEVKLKPNIDENDFSTKLKQARTFVEKGNKVKITCMFRGRELAYPEHGFKVVQKMSQGLEDIGFVEAEPKLAGRSLICVVAPGTVKTKKKQEKSHAQDENQ

SEQ ID NO: 512 - protein, 276 aa, Chlamydia pneumoniae
  VARIANT (1)...(276): Xaa = Any Amino Acid
MGNSGFYLQDTQNTIFADNIRLGQMTTVLKKDEVIIGTDTTPTVTKFSGDKGIVITTDSTITPSSTTFSLDMEAVIKEVTDKILTQIEDELVKDIIKNITQSLIEEVIKKIHIDPSFSYSRAFKDVNITNKIQCNGLFTKENIGNLDGGTEIASSSVTPDNANSMFLICADIIATRMEGTVALALVKEGDLSPCSISYGYSAGYPNIISLRATVGNKTTAPVKFSLRAGGMDSGVVWVNAMPNGEKILGVDAVSKITILEVKPQTNGTXXXXFXXX

SEQ ID NO: 513 - protein, 1044 aa, Chlamydia pneumoniae
MVEVEEKHYTIVKRNGMFVPFNQDRIFQALEAAFRDTRSLETSSPLPKDLEESIAQITHKVVKEVLAKISEGQVVTVERIQDLVESQLYISGLQDVARDYIVYRDQRKAERGNSSSIIAIIRRDGGSAKFNPMKISAALEKAFRATLQINGMTPPATLSEINDLTLRIVEDVLSLHGEEAINLEEIQDIVEKQLMVAGYYDVAKNYILYREARARARANKDQDGQEEFVPQEETYVVQKEDGTTYLLRKTDLEKRFSWACKRFPKTTDSQLLADMAFMNLYSGIKEDEVTTACIMAARANIEREPDYAFIAAELLTSSLYEETLGCSSQDPNLSEIHKKHFKEYILNGEEYRLNPQLKDYDLDALSEVLDLSRDQQFSYMGVQNLYDRYFNLHEGRRLETAQIFWMRVSMGLALNEGEQKNFWAITFYNLLSTFRYTPATPTLFNSGMRHSQLSSCYLSTVKDDLSHIYKVISDNALLSKWAGGIGNDWTDVRATGAVIKGTNGKSQGVIPFIKVANDTAIAVNQGGKRKGAMCVYLENWHLDYEDFLELRKNTGDERRRTHDINTASWIPDLFFKRLEKKGMWTLFSPDDVPGLHEAYGLEFEKLYEEYERKVESGEIRLYKKVEAEVLWRKMLSMLYETGHPWITFKDPSNIRSNQDHVGVVRCSNLCTEILLNCSESETAVCNLGSINLVEHIRNDKLDEEKLKETISIAIRILDNVIDLNFYPTPEAKQANLTHRAVGLGVMGFQDVLYELNISYASQEAVEFSDECSEIIAYYAILASSLLAKERGTYASYSGSKWDRGYLPLDTIELLKETRGEHNVLVDTSSKKDWTPVRDTIQKYGMRNSQVMAIAPTATISNIIGVTQSIEPMYKHLFVKSNLSGEFTIPNTYLIKKLKELGLWDAEMLDDLKYFDGSLLEIERIPNHLKKLFLTAFEIEPEWIIECTSRRQKWIDMGVSLNLYLAEPDGKKLSNMYLTAWKKGLKTTYYLRSQAATSVEKSFIDINKRGIQPRWMKNKSASTSIVVERKTTPVCSMEEGCESCQ

SEQ ID NO: 514 - protein, 346 aa, Chlamydia pneumoniae
MEADILDGKLKRVEVSKKGLVNCNQVDVNQLVPIKYKWAWEHYLNGCANNWLPTEVPMARDIELWKSDELSEDERRVILLNLGFFSTAESLVGNNIVLAIFKHITNPEARQYLLRQAFEEAVHTHTFLYICESLGLDEGEVFNAYNERASIRAKDDFQMTLTVDVLDPNFSVQSSEGLGQFIKNLVGYYIIMEGIFFYSGFVMILSFHRQNKMTGIGEQYQYILRDETIHLNFGIDLINGIKEENPEVWTTELQEEIVALIEKAVELEIEYAKDCLPRGILGLRSSMFIDYVRHIADRRLERIGLKPIYHSRNPFPWMSETMDLNKEKNFFETRVTEYQTAGNLSW

SEQ ID NO: 515 - protein, 327 aa, Chlamydia pneumoniae
MDAKMGYIFKVMRWIFCFVACGITFGCTNSGFQNANSRPCILSMNRMIHDCVERVVGNRLATAVLIKGSLDPHAYEMVKGDKDKIAGSAVIFCNGLGLEHTLSLRKHLENNPNSVKLGERLIARGAFVPLEEDGICDPHIWMDLSIWKEAVIEITEVLIEKFPEWSAEFKANSEELVCEMSILDSWAKQCLSTIPENLRYLVSGHNAFSYFTRRYLATPEEVASGAWRSRCISPEGLSPEAQISVRDIMAVVDYINEHDVSVVFPEDTLNQDALKKIVSSLKKSHLVRLAQKPLYSDNVDDNYFSTFKHNVCLITEELGGVALECQR

SEQ ID NO: 516 - protein, 101 aa, Chlamydia pneumoniae
MNNRQNTNDFIRIVKDVEKAFPELDIKVKIDKEKVTFLTSPTELYHKSISVILNLLNSIESSLDLFPDSPVVEELEKNNLKLKKALIMLILSRKDMFSKTE

SEQ ID NO: 517 - protein, 261 aa, Chlamydia pneumoniae
MKTIAFCSFKGGTGKTTLSLNVGCNLAQYSNKKVLLVDLDPQANLTTGLGVQSCYESNLNDIFRSSGNVRDIIQDTKIENLHIVPSSILIEEFREFNRNSVLDTSHLRSSLQLIESNYDLCILDTPPSLGTLTEEAFIASDHLIVCLTPEPFSILGLQKIKEFCSVLPKKKDLSVLGIVFSFWDGRNSTNSTYLNIIESIYEGKVLSSKVRRDITLSRSLLKETSIANAYPNSRASHDILRLTKEIEDKLFNKEMSAQEVL

SEQ ID NO: 518 - protein, 526 aa, Chlamydia pneumoniae
MNVLKYTKHSPSAHAWKLIGTSPKHGIYLPLFSIHTKNSCGIGEFLDLIPLISWCQKQGFSVIQLLPLNDTGEDTSPYNSISSVALNPLFLSLSSLPNIDTIPEVAKKLQDMHELCSTPSVSYTQVKEKKWAFLREYYQKCCKSSLEGNSNFSEFLESERYWLYPYGTFRAIKHHMHGEPINNWPKSLTDQENFPDLTKKFHDEVLFFSYLQFLCYQQLCEVKAYADQHHVLLKGDLPILISKDSCDVWYFRDYFSSSRSVGAPPDLYNSEGQNWHLPIYNFSQLAKDDYIWWKERLRYAQNFYSVYRLDHIIGFFRLWIWDSSGRGRFIPDNPKDYIKQGTEILSTMLGASSMLPIGEDLGIIPQDVKTTLTHLGICGTRIPRWERNWESDSAFIPLKDYNPLSVTTLSTHDSDTFAQWWLNSPKEAKQFAKFLHLPFQKTLTTETQIDILKLSHESASIFHINLFNDYLALCPDLVSKNLQRERINTPGTISKKNWSYRVRPSLEELAIHKKFNGYIEKILTGL

SEQ ID NO: 519 - protein, 147 aa, Chlamydia pneumoniae
MQNQYEQLLESLAPLLNTTLAPDKNNSCLIRFSDTHVPVQIEEDGNSGDLAVSTLLGTLPENVFRERIFKAALSVNGSFQSSIKGILGYGEVTQQLYLSDILSMNYLNGEKLFEYLKLFSLHAKIWMESLRTGNLPDLHVLGIYYVA

SEQ ID NO: 520 - protein, 635 aa, Chlamydia pneumoniae
MIPFTKTIGFRLWLACAVAIIAPLGINIVWLNLDQYRTIVSAISTALKENAAFKANTLTQIVPLNVDVLSLFSDVLDLDAGIPETPNVLLSNEMQKVFQGIYNEISLIKVFPNGDKIVVASSIPEHLGENYNHKIDIPKNTPFLAALKQSPKNQEVFSVMQANVFDAKTQELQGILYTTFSAESLLKDLLINKQSYLTVKTAILSKYGVILKASDPALHLHTVYPDMTKEKFCQVFLNDDPCPIDSELGPLTLSPLDIGENFYSFKIKDTEIWGCIENVPSIDIAVLSYAKKEESFAPLWRRARMYTAYFFCILLGSLIAFIVARRLSLPIRKLATAMIESRKNKNCLYTDDSLGFEINRLGHIFNAMVENLHKQQHLAKTNFEMKENAQNALHLGEQAQQRLLPNTLPSYPHIELAKAYIPAITVGGDFFDVFVVGEGSKARLFLIVADASGKGVNACGYSLFLKNMLRTFLSRSSSLQQAIQETSRLFYNNTKNSGMFVTLCVYCYHQTSNTMEYYSCGHPPACYLDPDGETSWLFHPGMALGFLPEVANITSKLFHPKPGSLFVLYSDGITEAHNNNNDMFGEERLQAAIQGLTGKSAADAVHRLMLSVKTFVGNSHQHDDITLLILKVLES

SEQ ID NO: 521 - protein, 314 aa, Chlamydia pneumoniae
MFSYIKNRILFNLLSLWIVLTLTFLVMKTIPGDPFNDEGCNVLSEEVLQTLKSRYGLDKPLYQQYTQYLHSIAKLDFGNSLVYKDRKVTNIISTAFPISAILGLQSLFLSIGGGIALGTIAALKKKKQRRYILGASILQISIPAFIFATLLQYVFAVKIPLLPIACWGSFTHTILPTLALAVTPMAFIIQLTYSSVSAALNKDYVLLAYAKGLSPLKVVIKHILPYAIFPTISYSAFLTTTVITGTFAIENIFCIPGLGKWFICSIKQRDYPVALGLSVFYGTLFMLSSLLSDLIQSIIDPQIRYAHGKEKKRK

SEQ ID NO: 522 - protein, 1240 aa, Chlamydia pneumoniae
MTWIPLHCHSQYSVLDAMSSIKDFVAKGQEFGIPALALTDHGNLYGAVDFYKECTQKGIQPIIGCECYIAPGSRFDKKKEKRSRAAHHLILLCKNEQGYRNLCILTSLAFTEGFYYFPRIDKDLLRQYSEGLICLSGCLSSSVSDAALKSPEALLLELQWFQDLFKDDYFTEVQLHKMSEESIAGFKEEWLKQEYYSLIEKQIKVNTAVLEASKRLGIPTVATNDIHYINANDWQAHEILLNVQSGETVRIAKQNTHIPNPKRKVYRSREYYFKSPAQMAELFKDIPEVISNTLEVAKRCDFTFDFSKKHYPIYVPESLKTLNSYTEEDRYQASAVFLKQLAEEALPKKYSSEVLAHIAKKFPHRDPIDIVKERMDMEMAIIIPKGMCDYLLIVWDIIHWAKANGIPVGPGRGSGAGSVLLFLLGITEIEPIRFDLFFERFINPERLSYPDIDIDICMAGRERVINYAIERHGKDNVAQIITFGTMKAKMAVKDVGRTLDMALSKVNHIAKHIPDLNTTLSKALETDPDLHQLYINDAESAQVIDMALCLEGSIRNTGVHAAGVIICGDQLTNHIPICISKDSTMITTQYSMKPVESVGMLKVDLLGLKTLTSINIAMSAIEKKTGQSLAMATLPLDDATTFSLLHQGKTMGIFQMESKGMQELAKNLRPDLFEEIIAMGALYRPGPMDMIPSFINRKHGKEIIEYDHPLMESILKETYGIMVYQEQVMQIAGALASYSLGEGDVLRRAMGKKDFQQMEQEREKFCKRACNNGIDPELATVIFDKMEKFAAYGFNKSHAAAYGLITYTTAYLKANYPKEWLAALLTCDSDDIEKIGKLIREAQSMGIPILPPHINVSSNHFVATDEGIRFAMGAIKGIGRGLIESIVEERDHHGPYESIRDFIQRSDLKKVSKKSIESLIDAGCFDCFDSNRDLLLASVEPLYEAIAKDKKEAASGVMTFFTLGAMDRKNEVPICLPKDIPTRSKKELLKKEKELLGIYLTEHPMDTVRDHLSRLSVVLAGEFENLPHGSVVRTVFIIDKVTTKISSKAQKKFAVLRVSDGIDSYELPIWPDMYEEQQELLEEDRLIYAILVLDKRSDSLRISCRWMKDLSIVNENIIYECDQAFDRIKNQVQKMSFTMSTSGKETKAKGNKPNENGHTQALAPVTLSLDLNELRHSHLCILKKIVQKHPGSRTLVLVFTQDNERVASMSPDDAYFVCEDIEELRQELVTADLPVRVITV

SEQ ID NO: 523 - protein, 576 aa, Chlamydia pneumoniae
MTDFPTHFKGPKLNPIKVNPNFFERNPKVARVLQITAVVLGIIALLSGIVLIIGTPLGAPISMILGGCLLASGGALFVGGTIATILQARNSYKKAVNQKKLSEPLMERPELKALDYSLDLKEVWDLHHSVVKHLKKLDLNLSKTQREVLNQIKIDDEGPSLGECAAMISENYDACLKMLAYREELLKEQTQYQETRFNQNLTHRNKVLLSILSRITDNISKAGGVFSLKFSTLSSRMSRIHTTTTVILALSAVVSVMVVAALIPGGILALPILLAVAISAGVIVTGLSYLVRQILSNTKRNRQDFYKDFVKNVDIELLNQTVTLQRFLFEMLKGVLKEEEEVSLEGQDWYTQYITNAPIEKRLIEEIRVTYKEIDAQTKKMKTDLEFLENEVRSGRLSVASPSEDPSETPIFTQGKEFAKLRRQTSQNISTIYGPDNENIDPEFSLPWMPKKEEEIDHSLEPVTKLEPGSREELLLVEGVNPTLRELNMRIALLQQQLSSVRKWRHPRGEHYGNVIYSDTELDRIQMLEGAFYNHLREAQEEITQSLGDLVDIQNRILGIIVEGDSDSRTEEEPQE

SEQ ID NO: 524 - protein, 439 aa, Chlamydia pneumoniae
  VARIANT (1)...(439): Xaa = Any Amino Acid
ITIAVNSTSGGLKISGDLKFHNNEGSFYDNPGLKANLNLPFLDLSSTSGTVNLDDFNPIPSSMAAPDYGYQGSWTLVPKVGAGGKVTLVAEWQALGYTPKPELRATLVPNSLWNAYVNIHSIQQEIATAMSDAPSHPGIWIGGIGNAFHQDKQKENAGFRLISRGYIVGGSMTTPQEYTFAVAFSQLFGKSKDYVVSDIKSQVYAGSLCAQSSYVIPLHSSLRRHVLSKVLPELPGETPLVLHGQVSYGRNHHNMTTKLANNTQGKSDWDSHSFAVEVGGSLPVDLNYRYLTSYSPYVKLQVVSVNQKGFQEVAADPRIFDASHLVNVSIPMGLTFKHESAKPPSALLLTLGYAVDAYRDHPHCLTSLTNGTSWSTFATNLSRQAFFAEASGHLKLLHGLDCFASGSCELRSSSRSYNANCGTRYSFXXXXXXXXFXXX

SEQ ID NO: 525 - DNA, 867 bp, C. Trachomatis D serovar
atgacccatcagcataaaaaaatcagcgaagaaacaatcgcctgtgacatgctagagcgctataccggctctaccgttcaagagttccagccctatctccttcttactaattttgcgtattacgtggatgttttcgctgaaatctatcaggtccctgtttctcgaggatccatgttttcggcagcgcatgcgcctcaaattcacacctcaatcatcgattttaaattaggctctccaggagcagctcttaccgtagatctgtgttctttccttcccaatgctacagcagcgatcatgttgggcatgtgtggaggcttaagatcccactaccaaataggagattattttgtccctgttgctagcatccgaaaagatggaacatcagatgcatacttccccccagaggtccctgcattagctaattttgtcgtacaaaaaatgatcaccaatattctcgaagccaaaaacctcccttaccatataggcatcacccacacgactaacattcggttttgggagtttaataaagagttccgtcgaaaactatatgaaaataaagctcaaactgtcgagatggagtgtgccaccttatttgctgcaggataccgaaggaatcttcctttaggagcacttttgctgatatcggatctacctttgcgaaaagatggaattaaaactaaggaaagcagttcggcagtcctaaactctcacaccaaagagcatatactaacaggcgttgaggtgtttgcctctctacaagagaaatcaggcccaggaatcaagaaaacaaaaggcttgccgcacatggagtttgggcaagccgatgattctctttctgaacaaactgaagtttctggcggggatttc

SEQ ID NO: 526 - DNA, 1182 bp, C. Trachomatis D serovar
atgtcaaaagaaacttttcaacgtaataagcctcatatcaacatagggaccattggccacgttgaccatggtaagactacgttgacagctgctattacgcgtgcgttgtctggagatgggttggctgattttcgtgattatagctctattgacaacactcctgaagaaaaagctcgcggtattacaattaacgcttcccacgttgagtacgaaacagctaatcgtcactacgctcacgtggactgccctggtcacgctgactatgttaaaaacatgatcaccggtgcagctcaaatggacggggctattctagtagtttctgcaacagacggagctatgcctcaaactaaagagcatattcttttggcaagacaagttggggttccttacatcgttgtttttctcaataaaattgacatgatttccgaagaagacgctgaattggtcgacttagttgagatggagttggttgagcttcttgaagagaaaggatacaaagggtgtccaatcatcagaggttctgctctgaaagctttggaaggggatgctgcatacatagagaaagttcgagagctaatgcaagccgtcgatgataacatccctactccagaaagagaaattgacaagcctttcttaatgcctattgaggacgtattctctatctccggacgaggaactgtagtaactggacgtattgagcgtggaattgttaaagtttccgataaagttcagttggtcggtcttagagatactaaagaaacgattgttactggggttgaaatgttcagaaaagaactcccagaaggtcgtgcaggagagaacgttggattgctcctcagaggtattggtaagaacgatgtggaaagaggaatggttgtttgcttgccaaacagtgttaaacctcatacacagttcaagtgtgctgtttacgttttgcaaaaagaagaaggtggacgacataagcctttcttcacaggatatagacctcaattcttcttccgtacaacagacgtcacaggtgtggtaactctgcctgagggaattgagatggtcatgcctggggataacgttgagtttgaagtgcaattgattagccctgtggctttagaagaaggtatgagatttgcgattcgtgaaggtggtcgtacaatcggtgctggaactatttctaagatcattgca

SEQ ID NO: 527 - DNA, 1650 bp, C. Trachomatis D serovar
gtggaatcttcccgtattcttattacttctgcgttgccttacgcaaatggtcctttgcattttggacatattaccggtgcttatttgcctgcagatgtttatgcgcgttttcagagactacaaggcaaagaggtcttgtatatttgtggttctgatgaatacggaatcgcaattacccttaatgcagagttggcaggcatggggtatcaagaatatgtcgacatgtatcataagcttcataaagataccttcaagaaattgggaatttctgtagatttcttttccagaactacgaacacttatcatcctgctattgtgcaagatttctatcgaaacttgcaggaacgcggactggtagagaatcaggtgaccgaacagctgtattctgaggaagaagggaagtttctagcggaccgttatgttgtaggtacttgtcccaagtgtgggttcgatcgagctcgaggagatgagtgtcagcagtgcggtgccgattacgaagctagagatctgaaagagcctcgttctaaattaacgggggcagctttatctttacgtgatacggaacatgcttacttgcatttggagcgcatgaaagaagatttgcttgctttcgtgcaaggtatttatctacgtcctcatatgcgtaatttcgttacggattacatcgagcatttacgtcctcgagcagtgactcgagatttgtcttggggaatacccgttcctgatttggaaaataaggtattctatgtatggttcgatgctccaattggttacataagtggaactatggattgggcagcatcgattggagaccctgaagcttggaagaagttttggttggacgatactgtgacctacgcacagtttataggtaaagataatacttctttccatgcggctattttccctgctatggaaataggacaatctcttccctataagaaagtggatgctcttgtaacatcagaatttttattgttagaaggtttccagttcagtaaatcggatgggaattttatagacatggatgcgtttttagaaacgtattccttggataaactgcgttatgtgttggcagcgattgctccagagacttcggatagcgaattctctttccaagagttcaagacgcgatgcaattctgagcttgtagggaagtatggaaattttgtgaatcgagttctagcttttgctgttaagaatggatgcacagagctttcttctcctcaattagagcaaaaggatttggattttatctcaaaatctcaaaaacttgctaaggatgcagccgaacattacgcacaatacagtttgcgtaaggcgtgttccacgattatggaattagctgctttagggaatggctatttcaatgatgaagctccatggaaattggctaaagagggtaactggaatcgggtacgcgctattctattctgtgcttgttactgccagaagttgctagctctcatttcctatcctattatgcctgaaacagcattgaagattttggaaatgatagctccacattccttagatctaggttcccaagatccagatagattacaatctctttggacagattccttttttgattactcggaagagaaattttctctgaaagagcctgaattattgttcacaatggtagag

SEQ ID NO: 528 - DNA, 300 bp, C. Trachomatis D serovar
atggctagaaaagatcgtttaactaatgaaagactgaataagctatttgatagcccctttagtttggttaattacgtaattaagcaagctaagaacaaaattgctagaggagatgttcgttcttctaatgtcgcgattgaggcgctgaacttcctggatctttatggcattcagtccgaatacgctgaaagagatgatcgagagagacatttgtctgctacaggagagagacgaagagaacaaggtttcggaacatccagaagaaaagatccttctctgtacaactggagcgacgtgaaa

SEQ ID NO: 529 - DNA, 615 bp, C. Trachomatis D serovar
atgtcagtaaaggttatttcccccttttctcaagacggggttcaatgctttcccaagctttttatcattagcgctcctgctggagcagggaagacaacactcacccatatgctacaaagagagtttcctgatgcatttgagaagacggtgtcgtcaacgacacgttcggctcgtccaggcgaagtgcatggcgtggattatttgtttgtatctgaagatgactttaagcaatctttagatagggaagattttttggaatgggtctttttatttgggacttattacggaacgagtaaggcggagatttctagagttctgcaaaagggtaagcactgtatagccgtgattgatgtacaaggagctttggctctgaagaagcaaatgccggcagtcactatttttattcaagctccctctcaagaagaacttgagcgccgtttgaatgctcgggattcagagaaagatttccagaagaaagaaagattagagcatagcgctgtcgaaattgctgccgctagcgaatttgattatgttgtggttaatgatgatttgattacagcatatcaagttttaagaagtatttttatagctgaagaacataggatgagtcatggc

SEQ ID NO: 530 - DNA, 1806 bp, C. Trachomatis D serovar
ttgaaaccgtataaaattgagaacattcgtaatttttctatcattgctcatatcgaccacgggaaatctacgatcgcagatcgtttgttagaaagtactagtactatcgaacaaagagagatgcgcgaacaacttttagattctatggatctagaaagagaacgcgggattaccatcaaagcgcatccggtcactatgacctatgaatacgaaggggagacttacgaactcaatctaatagatactcctggacacgtagatttctcttatgaagtatcccgatcactagcagcttgtgaaggagcgctgcttatagtagatgctgcccaaggtgttcaagctcaaagcttagctaatgtatatctggctctagaacgagatttagaaatcattcctgttttaaataaaatagacttacctgctgctcaaccagaagctataaaaaaacaaatcgaagagttcatcggattagatacttcaaacaccattgcttgctcagcgaaaacaggtcagggtatccctgaaattttagagtctattatacgactcgttcccccaccaaaacctccacaggaaacagaacttaaagctttgatctttgattctcactacgatccttatgtaggaatcatggtttatgtacgcgtgatcagtggagaaatcaaaaagggagatcgcattaccttcatggcaaccaaaggctcctcttttgaggtcttaggaataggagctttcttaccggaagctactctcatggaaggatccttacgagccggacaagtgggatacttcattgccaacctaaaaaaagtaaaggatgtaaaaattggcgatacagtcactactgttaaacatcctgctaaagagcctttagaaggctttaaagaaatcaaacctgtagtgtttgctggtatctatcctatagattcttctgactttgataccctgaaagatgctctaggccggttgcagctaaacgactcagctcttacgattgaacaagagaacagtcattctctcggatttgggttccgctgtggatttttaggactgctgcacttagaaatcatctttgagagaatctctagagaatttgatctcgatattattgctacagctcctagcgttatctacaaagtcgtcttaaaaaatggtaaaaccctttttattgataacccaacagcatatcctgacccagctcttattgaacacatggaggagccttgggtccatgttaatatcattacgcctcaagagtatctcagcaatattatgagcctttgtatggataagcgtgggatctgtctaaaaacagatatgcttgaccaacacagactggtgctttcatatgagctgcctctcaatgagattgtttctgatttcaatgataaactcaaatctgtgacgaaaggatacggctcctttgattaccggttaggagattataaaaagggtgctatcattaagctggaaattctaattaatgatgaggctgttgatgccttttcctgccttgtacacagagacaaagcagaatcaaaaggcagaagcatctgcgagaaactcgtagatgttatccctcctcagctctttaaaatccctattcaggcggccatcaataaaaagattattgccagagagacgattcgagctttagcgaaaaatgtaactgctaagtgctatggtggagatatcacaagaaaacgcaagttgtgggacaaacagaaaaaagggaagaaacgaatgaaagaattcggaaaagtatccattccgaacacggcgtttgttgaagtccttaaaatggag

SEQ ID NO: 531 - DNA, 972 bp, C. Trachomatis D serovar
gtggaactacttcctcatgaaaaacaggttgtcgaatacgaaaaaacgatcgccgagtttaaagaaaaaaataaagaaaacagcctgctttcttcttcagagattcaaaaattggataagcgtttagatagattaaaagaaaaaatttattccgatctcaccccttgggaaagagtacaaatttgtcgacatccttcgagacctagaacagtgaattatatcgaaggaatgtgcgaagagtttgtagaactttgtggagatcgaacgttccgagatgatcctgcagttgtcggagggttcgcaaagattcaagggcagcgtttcatgcttatagggcaagaaaagggttgcgacacaaaatctcgcatgcatcgtaacttcgggatgctttgtcccgaaggctttagaaaggctctacgcttagctaaaatggcagagaaattcggtttgccaattatctttctcgttgatacccctggagctttccctggattaacagccgaagaaagaggtcaaggttgggctattgcgacaaacttatttgagttagctagattagctaccccaatcattgtaattgtgattggtgaaggatgttcaggaggcgctctaggaatggctataggagatgttgtagcgatgctagaacactcgtattattctgtaatttctcctgaagggtgtgcttctattttatggaaagatcctaaaaagaacagcgatgctgctgccatgttaaaaatgcatggagaggatcttaagggatttgctattgtggacgcagtgatcaaagaacccataggtggggctcatcacaatcctgcggccacatatcgtagtgttcaagaatatgtccttcaagaatggcttaaattgaaagatttaccggtagaagagttgctagaaaaacgatatcagaaattccgaacgataggtctatatgaaacttcttctgaaagcgattctgaggca

SEQ ID NO: 532 - DNA, 1938 bp, C. Trachomatis D serovar
atgaaacttcttctgaaagcgattctgaggcataagaagcatttagttttattcggtttttctcttttatccatattagggctaacaataacgtctcaagcagaaattttttctctaggtcttattgctaagacaggtcctgatacgtttcttctttttgggaagcaggagggagcttccttagtcaaaaggaaagagctgtccaaagatcaacttcttgaacagtgggataatattgttggtgagggagacacgctatctttgcctcaagcgaatgcttatattgcgaaacattcaggaggctctcagtcaataacaaaaaggctttccgcctatctctctggttgttttgacttttctcgtttgcaatgcctcgcgctttttctagtagttgttgctattttgaaatcaacaacgctattttttcagaggtttttagcacaattaattgctattcgtgtgagctgctctttacgtaaagattacttcttagctttacaaacgctcccgatgacattctttcatgcacacgatatggggaatctaagtagtcgtgtgatagcagattcatctatgattgcattagctattaatgcccttatggtgaattacattcaggctcctatcactatgactttagccttagtagtgtgcttgtctatttcttggaaattttgtgcttgtgtttgtttagcgttccctatttttattttgccaattgttatcattgcaaagaaagttaaagcattggctaaacgaattcaaaagagtcaagatcattctgccgctgcgttattggattttcttttaggtattcttacagtaaaagtatttagaactgagcagttttcttttagtaagtattgtcagaaaaatgatgagattgctcgattggaagagcgcagtgctgcgtatagtttaattccaagacctcttctgcacactattgcctcgttgttctttgctttggtcattatgatcggtttgtatcattttcatatcccacctgaggagcttgtggtcttttgtgggcttttgtatctcatttatgatccgattaaaaagtttgctgatgaaaatgcgaatatcatgtggggatgcgctgctgcagaacggttttatgaagtattggatctagcaaagcagcagtccaatgtttctgaaaagttaaatgaattccagggattacaacatagtattcagttttgcaatgtatcctttggatatgtagaggatagtcccgtattatcggatttcaacttagtattaaaaaaaggggaggctatcggtattgttggtccaacaggatctgggaaatctaccatagcaaagttattgccaaggctttatgaagtctctcatggcgaactgttaattgattcacttccgatacgaagctactgcaaaaattctttaaggaaacatattggttgtgtgctgcagcatccatttttattctatgatacggtgtggaataacctgacttgtggcagaaccttttcagaagaagaagtatttcatgctttaaagcaagctcatgcctacgaatttgtttctaaaatgcctcaaggcgtgcacagcttattagaggaatccagtaaaaatttatctggaggtcagcagcaacgtttgacaatagctagagcattgctgcataacacctccattctgttgctagatgaggcaacatcagcattggatgccattagcgaaaattatgttaaagagatagtcgggcagttaaaaggccgttgtacacaaattatcattgcccacaagctctccactctcgaatacgtagatcggattgtttacttggaacaagggaagaaaatagcagaaggaaccaaagaagagttattagactcttgcccagcttttcaaagaatgtgggtcttatcgggtgctaaggactgggaactcaatgctgtcgtaaaa

SEQ ID NO: 533 - DNA, 1242 bp, C. Trachomatis D serovar
atgttttcttcagcaattgttattctaactgcaatttttgtcttgtgctcggggtttgtttctttatcgcatatagctttattctcgctcccttcttcccttattgctcattacagtcactcaaaaaataggcagctccgacaaattgccaatcttatggcctaccccaatcatttgctcatgaccctagtcttcttcgacatagggattaatattggagtgcaaaactgcatagcaaccttagtaggcgattcggcatctctattgcttaccgtaggagttcccctcgctttgacactagttttgggagaaattgtccctaaggttatcgcaatcccttacaatgcacgaattgcaaagattgtaaccccaatcatctttgcctcaactaaaagcttccgccctatatttgattgggctatctcgggtatcaattttatcgttcagaaaatgttggcccgtcaagaaagtgattttattcaaccccaagaattaaaagaagtcctccgaagctgtaaagatttcggagttgtaaatcatgaggaaagtcgtcttctatttggctatctatccatggaagaaggtagcattaaagaacgcatgacgcccaaacaagaaatcattttttatgatgtccttactccgattgaaaatttatataaactcttctctggacctaaacaaagctattccaaagttctagtttgtaaaggtggtctacaaaatctcttaggagtttgttctgcaaaattgcttcttctctacaaagaaaaattacaatctgccgaagaactcttgcctctccttcgtaaacctcactacattcctgaaacagtatcagctaagacagctttgtatcatctagcaggagaagactgtggtttaggtattatcattgatgaatatgggtctatagaaggattgatcacccaaaatgatctatttaaaatagtctctgatggggtagctcataatcgcccatcttttaaacaattcgctcactcagacaagaatgttgttattgctgcaggcacctatgagctttctgatttctatgacctgtttggagttgatcttcctactacagctaattgcgttaccataggcggatggctgacagaacaattaggagaaatccctgaaacaggaacaaaattcgcttggggacaatttgtattccaaatactagacgcggctcctaattgtgtgaaacgggtgtatataaggaaaacccatggaaac

SEQ ID NO: 534 - DNA, 1212 bp, C. Trachomatis D serovar
atggaaactaactctccctttttctggttaggagtgaacctcctttgtatttttgtccaagggttcttttccatgatggaaatggcttgcatatcattcaatcgcgtgcggttgcaatattaccttacgaaaagcaataaaaaagcctcttacattaacttccttgttagaagaccttatcgcttatttggaaccgtaatgttgggagtaaatattgctttgcaaatagggtctgagtcatcacgaacttgttacaaactcctagggatttctcctgaatatgctcctgcaacgcaaattattttagtcgtcatttttgctgaattaattcctttagctatctctcgtaaaattccagaaaaaatcgccttaaaaggagcccctatcctctatttcgctcactatcttttctatccgctcatccaatgtgtcggtggcattaccaatatgatctactttattctgaatattaaggaagagacgctccactcaacgcttagccgagatgaattgcaaaagacattagaaactcatcatgaagagcatgatttcaatgtgatagctacaaatattttctctttaagcgcaacttctgtagagcaagtatgtcaatatttggaccaaatcccgatactttcagctaccgcttccgtacgagatgtttgccagctcgttcgtcgccatcgtttagattttgtccctgtttaccataaagttaaaaagaatgtagtgggaatagcttttccaaaaaacctcattaatcgaaatcccagtgaccctgttgtcccttacctaagctctccctggttcataacagctaaatctaagctcattcatgcgatccaagaattccgcaagaatagttctaacgtcgccattgttttaaataataatggcgagcctatgggagttttaggcttacatacggtgtttaaaacgttattcaacacaagaaatatcgcccaattaaaacccaaaccaacttctttaattgaacgaactttctctgggaacacacctttgtctgaaatagaaaatgagctcgatattatttttatggataatgattgtacaacaattgagcaactcatgttaaaacttctggatactcctccagaagtaggcgcctctatcattatcaacgacctactgttagaggtaaaagagatttccttgtacggcatcaaaactgttgctatcaaagatactctg

SEQ ID NO: 535 - DNA, 1617 bp, C. Trachomatis D serovar
atgtgttgtgtggatggatctaattccatccaacaacgaatgcgtttttgtgagtatcgtaccgcagcgcaagaggctaagacctcattatcttccgattgttccttactagaagctcgcttggctttacgagccttagccaaacatcatgaatattctgcttggagagaggccttcctccgttctcaagaacgctttccttcattggaagcagatcgtgatattcatgaggatcttgcagcttctcttctacaaaaaaatattagacattcttcacttaccgttcgagtaattactattttagctgtagggatggcgagagactatcggttagtgcctattgttttgcaggctttgtctgatgatagcgataccgtacgtgagattgctgtacaagtagctgttatgtatggttctagttgcttactgcgcgccgtgggcgatttagcgaaaaatgattcttctattcaagtacgcatcactgcttatcgtgctgcagccgtgttggagatacaagatcttgtgcctcatttacgagttgtagtccaaaatacacaattagatggaacggaaagaagagaagcttggagatctttatgtgttcttactcggcctcatagtggtgtattaactggcatagatcaagctttaatgacctgtgagatgttaaaggaatatcctgaaaagtgtacggaagaacagattcgtacattattggctgcagatcatccagaagtgcaggtagctactttacagatcattctgagaggaggtagagtattccggtcatcttctataatggaatcggttcaaaagttagcttgtaattcactttctgctcgtgttcagatgcaagctgcagccattctctatttagaaggagatcctttcggagaagataagcttacagaaggtttatcagctacttccagcatcctttgtgaagctgcctcagaagcggtctgctcattagggattcatggagttcatttagctggacgttttttatcaaaagtacaaggaatgcgttctcgagtgaatcttgctttcgcgcttttggtaagtcgagagaaggtagaagaagctggagatgttgttgcttcttttattcatagaatagagccctgtcgagctattgaacagtttttatgtgaagatcagaagatttttgtagcttcatctcctctgcaggtagaaatcatgaaaagggatttggcgaagaagatcattcgtttattagttgcagctcagtacagcaaagcaaaaatggttgtcgctcagtatttagcagggcagcaggtgggatggagtttctgttctgaagtcttttgggaagaaggggatagcgaggattttgttgaaccattacaagaagagagttttgcgtttgccttagagaaagctctttcttttttgcaacgcgaaggaggagaagctgggttgcatgcagtgatcagtttatatccacatagtcgctggcaagacaagttgactatcttggaagcaattgcttattcagaaaatagaatcgctacatgttttttaagagagcgttgtctgcaggaagcggcctctttacaatcggcagctgcaggagctgtattcgccttattcaaa

SEQ ID NO: 536 - DNA, 312 bp, C. Trachomatis D serovar
atgcaaacttcccggatcagctcttttttccgagggcttgttcacctgtaccgttgggcgatttctccttttctcggggctccttgtcgctttttccctacatgctctgagtacgctcttgttgcactaaagaaacatccgctcagaaaaagcctttttctcatcgccaagcgcttactcaaatgcggcccttggtgcataggaggtatcgatctcgtccctagaacttctgttgaagaatatctcagttcccctacccctctagcagaatccccagacgacaggactgtgccacacacccaagaaacttct

SEQ ID NO: 537 - DNA, 1008 bp, C. Trachomatis D serovar
atgcagcttttttttggtagattttacgaagtggcgtgtatagtagcaagtattttgagggagagggatgtaggagtttttatggggatagaaggaagaggatcaggagctatgcaaagtaaaaaaacgattaaatggctgaagcaagctctcgttcttagttctattgtgaatatcctattactgcttttgatttattcgaccgtatttagaaaagatatttataaattacgggtttttccagggaatctcatcgctaaaagttcacgaatagggaagattcctgaagacattttggaaagactagaaaatgcttcgtttgccgatttattagccttgttgcaggaagagagaatggttttcggccatccattaaaatcttgggctctaggggtgagcatccaaaaatattttgtagatatcgctcctatgctgacgcatcctttaacttttattagactcaaaagtcctgaacgtacttggttacttccggatattaatgatcaggagtttacacggatttgtcagtatttgcttacagagaggttcccattctcttcacgaggtttttttcgtattatggtgcgtgattgtgaagcagggatggtggatgaagatgttctgtatcggttttgtcatcttcctgagtttctctatgtgcgttctctcctttttggtgcggaaatcgaagctgcttcggtcgcttctctggcaagaatgattatccaaggaggggaggacttattcttttccctgtgttgtttagaaaatcgtcaaacggcgatttctgatcatcagaggcgctgttttctgaaagcttatgtggatagacaggaacctttagcagctcttctcttgttagtacatgacgcggactgggtgttgcatgagttttctgatagcgatttacaatcctttattcaacttttgcctagagaggcacactatactaagaagtttcttgggtgtgtggcacagtcctgtcgtctggggattctgctagagggg

SEQ ID NO: 538 - DNA, 1278 bp, C. Trachomatis D serovar
atgtatgttcgctctatcttttttagtattatcgccttcctaacggtcggatgctccttttctcctccagaatcgggcttaatcatagccattcacgatgatcctcgctctctttctccagaaaaaggagaaaatgctttccatttttctttgtccaaggctttatttgctactctcttcagagaagagctctctggattaacccctgctctggtctcctcctatcaagtttcggaagacgggcggttttatcgtttttgtattcgtaaagatgctaagtggagtgacggctctcttttacttgcagaagatgtaatagctgcttgggaacacactaaacaagctgggcgatattccctactttttgaaaagctatcttttcgagcctcttcttcttcagaaatccttattgaactcaaagaacccgagcctcaactattggcgatattagcctctccgttttttgctgtgtatcgtccagaaaatccttttctttcttctggaccttttatgccaaaaacctatgtgcaagggcaaacgctcgttctacaaaaaaacccttattactatgaccatgcgcatgtggaattacattccatagactttcgcatcattcccaacatttacacagctctacacctcttaagaagaggtgacgtggattgggtggggcagccttggcaccaagggattccttttgagcttcggactacctctgctctctacacccattactctgtagatggcacattctggcttattcttaatcccaaagatcctgtactttcctctctatctaatcgtcagcgattgattgctgccgtccaaaaggaaaaactggtgaagcaagctttaggaacacaatatcgagtagctgaaagctctccatctccagagggaatcatagctcatcaagaagcttctactccttttcctgggaaaattactttgatatatcccaataatattacgcgctgtcagcgtttggccgaggtattgcaagaacaatgccgagacgcaggtatccagctgactcttgaaggactcgaataccatgtatttgttcaaaaacgagccactcaagatttctctgtctccacagcaacttctatagctttccatccccttgctaaatctaagttcgatcaaacggctctagacaatttcacttgtctgcccttgtaccacatagaatatgattatattttgagcagaccgctagatcaaattgttcactatccttcaggtagtgttgatttgacctatgcacactttcac

SEQ ID NO: 539 - DNA, 1815 bp, C. Trachomatis D serovar
atgcaaaatattcttcgaacttcttcttgcagatatatgtttttgctgggtattcgttcggtgtggaatcgggtggctgttgtgaataactttagaggaagttcatggaaaattgtagcaatccccagttgtatactgtttactttgatattccatttacctagatggctgattgattttggggtatgtacaaatttagcgtgctccttgtcgatcattttttgggtgttttctctacgctcttcagcttcggctcgtattttcccttctctccttttgtatctttgtctattgcgacttggcctgaatttagcctccacccgatggattttatcttctggatgggcttctcctttaatttttgcgttagggaatttcttttcccttgggagcatcccggttgctcttacggtatgtttactcctgtttttagtgaattttctcgtcataactaaaggagcagagcgtattgcggaagtgcgagctcgtttttcattagaagcgctcccaggtaaacaaatgtctttagatgctgatattgctgctggaaggatcgggtatagcagagcgtctgttaaaaaaagctctcttttagaagagagtgattacttctccgccatggagggcgtattccgctttgtaaaaggcgatgcgataatgagttgggtgttgttaggagtgaatatcctagctgctctgtttttaggacgagctactcatgttggcgatttgtggttaactgtattaggcgatgctttagtgagtcaaattccagcattgcttacatcgtgtgcagcagcaacgcttatagctaaagttggggaaaaagaaagtctagcgcagcatctgctagattattatgagcagagtcgccagagttttctttttatcgctttgatcctatgtgggatggcttgtattccaggagctcctaaagctctgatcctaggtttttcagttttattattcttagggtataagaatccttcttcaggagagactcttctcttccagaaagaacgggtagagtttgtattgcctgatgagggagtgggaaatcctgctaatttgtacaaggacgcccgcaatcagatttatcaagagttaggcgtagttttcccggaagctattgttgtacgtcatgtaacaggatcttctccacgtttaatcttttctgggcaagaggtcgctttgagagagctgtcttgcccagctatactagaatcgattaggcagctagctccagaaacgatcagtgaacgcttcgttactcgcttagttgatgagtttcgagagcatgcattcttatcgatagaagagatccttccgttaaaaatatcagagaattctttgattttcttattgagagctcttgttagagaacgagtgtctttgcatttattccctaagattctcgaagctatagatgtatatggctctcaaccaaagaattctcaggaattggtagagtgtgtacgaaaatatcttgggaagcaaattggtttatccttatggaatcgccaagatgtcttagaggtaattacgatagactctctggttgagcagtttgtgagagattcacaagaaaaggttgtgttggatttaaatgaaaaagtagttgctcaggtgaagcatttattgcgggtaggggaggggaattttcgagctatcgtaacgggatccgaaacaagaaaagaactgaaacgcatagtggatccttatttcccagatttattggttttagcacatagcgaacttccagaagagatccctataactttgttaggagcggtgtctgatgaggttttattatca

SEQ ID NO: 540 - DNA, 519 bp, C. Trachomatis D serovar
atgaaaaagttcttattacttagcttaatgtctttgtcatctctacctacatttgcagctaattctacaggcacaattggaatcgttaatttacgtcgctgcctagaagagtctgctcttgggaaaaaagaatctgctgaattcgaaaagatgaaaaaccaattctctaacagcatggggaagatggaggaagaactgtcttctatctattccaagctccaagacgacgattacatggaaggtctatccgagaccgcagctgccgaattaagaaaaaaattcgaagatctatctgcagaatacaacacagctcaagggcagtattaccaaatattaaaccaaagtaatctcaagcgcatgcaaaagattatggaagaagtgaaaaaagcttctgaaactgtgcgtattcaagaaggcttgtcagtccttcttaacgaagatattgtcttatctatcgatagttcggcagataaaaccgatgctgttattaaagttcttgatgattcttttcaaaataat

SEQ ID NO: 541 - DNA, 1062 bp, C. Trachomatis D serovar
atgtctcaatccacttattctcttgaacaattagctgattttttgaaagtcgagtttcaaggaaatggagctactcttctttccggagttgaagagatcgaggaagcaaaaacggcacacatcacattcttagataatgaaaagtatgctaaacatttaaaatcatcggaagctggcgctatcatcatatctcgaacacagtttcaaaaatatcgagacttgaataaaaactttcttatcacttctgagtctccttccctagtttttcaaaagtgtttagaattattcattactcctgttgactcaggattcccaggtattcatccgacagccgttatccatccaactgcgattattgaagatcatgtttgtattgagccctatgctgtagtttgtcagcatgctcatgttggatctgcttgccatattgggtcaggtagcgtcattggagcttattcaaccgttggagaacactcttatatccatcctcgagtagttattagagaacgagtctctattgggaaacgagtaattattcaaccaggagctgttataggctcttgtgggttcgggtatgttactagtgcttttggacagcacaaacatttaaaacacctcgggaaagtcattattgaagacgacgtagagatcggcgcaaatacaactatcgacagaggccggtttaaacacagtgttgtgcgtgaaggttcgaaaattgataatcttgtgcaaattgcccatcaggtggaggtcggtcaacacagcatgattgtagctcaagctggaattgcaggttctacaaagattggcaatcatgtaattatcggtggacaagccggcataaccggacatatttgcattgcagatcatgtcattatgatggctcagactggcgtcactaaatctattacttctccagggatctatggcggagcgcctgctcgtccatatcaagaaattcatcgccaagtagccaaagtacgcaaccttccacgactcgaagaacgtatcgcagcacttgagaaactagtccagaaattagaagctctctcagaacaacat

SEQ ID NO: 542 - DNA, 1263 bp, C. Trachomatis D serovar
atgactgcatcaggaggagctggagggctaggcagcacccaaacagtagacgttgcgcgagcacaagctgctgcagctactcaagatgcacaagaggttatcggctctcaggaagcttctgaggcaagtatgctcaaaggatgtgaggatctcataaatcctgcagctgcaacccgaatcaaaaaaaaaggagagaagtttgaatcattagaagctcgtcgcaaaccaacagcggataaagcagaaaagaaatccgagagcacagaggaaaaaggcgatactcctcttgaagatcgtttcacagaagatctttccgaagtctccggagaagattttcgaggattgaaaaattcgttcgatgatgattcttctcctgacgaaattctcgatgcgctcacaagtaaattttctgatcccacaataaaggatctagctcttgattatctaattcaaacagctccctctgatgggaaacttaagtccactctcattcaggcaaagcatcaactgatgagccagaatcctcaggcgattgttggaggacgcaatgttctgttagcttcagaaacctttgcttccagagcaaatacatctccttcatcgcttcgctccttatatttccaagtaacctcatccccctctaattgcgctaatttacatcaaatgcttgcttcttacttgccatcagagaaaaccgctgttatggagtttctagtaaatggcatggtagcagatttaaaatcggagggcccttccattcctcctgcaaaattgcaagtatatatgacggaactaagcaatctccaagccttacactctgtaaatagcttttttgatagaaatattgggaacttggaaaatagcttaaagcatgaaggacatgcccctattccatccttaacgacaggaaatttaactaaaaccttcttacaattagtagaagataaattcccttcctcttccaaagctcaaaaggcattaaatgaactggtaggcccagatactggtcctcaaactgaagttttaaacttattcttccgcgctcttaatggctgttcgcctagaatattctctggagctgaaaaaaaacagcagctggcatcggttatcacaaatacgctagatgcgataaatgcggataatgaggattatcctaaaccaggtgacttcccacgatcttccttctctagtacgcctcctcatgctccagtacctcaatctgagattccaacgtcacctacctcaacacagcctccatcaccc

SEQ ID NO: 543 - DNA, 693 bp, C. Trachomatis D serovar; identical to SEQ ID NO: 413

SEQ ID NO: 544 - DNA, 729 bp, C. Trachomatis D serovar
atgaaaataactccgatcaaaacacgtaaagtatttgcacatgattcgcttcaagagatcttgcaagaggctttgccgcctctgcaagaacggagtgtggtagttgtctcttcaaagattgtgagtttatgtgaaggcgctgtcgctgatgcaagaatgtgcaaagcagagctgataaaaaaagaagcggatgcttatttgttttgtgagaaaagcgggatatatctaacgaaaaaagaaggtattttgattccttctgcagggattgatgaatcgaatacggaccagccttttgttttatatcctaaagatattttgggatcgtgtaatcgcatcggagaatggttaagaaattattttcgagtgaaagagctaggcgtaatcattacagatagccatactactccaatgcggcgtggagtactgggtatcgggctgtgttggtatggattttctccattacacaactatataggatcgctagattgtttcggtcgtcccttacagatgacgcaaagtaatcttgtagatgccttagcagttgcggctgttgtttgtatgggagaggggaatgagcaaacaccgttagcggtgatagagcaggcacctaatatggtctaccattcacatcctacttctcgagaagagtattgttctttgcgcatagatgaaacagaggacttatacggaccttttttgcaagcggttacgtggagtcaagaaaagaaa

SEQ ID NO: 545 - DNA, 1149 bp, C. Trachomatis D serovar
atgcttccacatcagcagaacagcagttctgaacgtgcccgtcatcacgaatctcgctcacatcggcattcctcatcatcaagacatcatgttacgcgatctcaatcaagcgcactccctcaattgcaagagcgtcctgtgcctcatccacttgcagaaagagaattgattatattccattccgtacatcagcagcagaataataatcctctaagaatgatttgcgataccattcgccaagctcaaagagggatatttatgcgcatttacaccatatcatctgatgacattatccaatctctaattcagacttcgcaccatgttcctgtagaagtcaaataccattgcggagaaagcttacctgtagcatgtcaaaactcgagagtcgtcttgcgtctgactaacggaagaaccctccaacataaaaaaactatgttggctgatttccaaacagtagttacaggatcagccaactacacggacttgtctctcaatcacgatgccaacgtgacggcatgtatagaaagttcagaattacatgacgcagtcttttctgaaagaccccaactggttcatgtcggacctcagctgctcaattacattcctatccagcgtttgattcctaatgcagcatcaaaaatgattttgaatgcaattaaccaagcaacggacagtatttttgtcttgatgtatatcttcttaagcccagaattcttcttagctcttgcccaagctatgcgaagaggagttcgagtaaaagtaatcatcgacaaccattccaaacaagatacatgcaaactactgagcaaattgggtatccaacttcctatttacgaaagaaaaacggaaggcgttctccatactaagatttgttgcatcgacaataaaactctaatctttggctctgctaactggagcggtgctggtatgattaaaaactttgaagacctattcatccttcgcccaattacagagacacagcttcaggcctttatggacgtctggtctcttctagaaacaaatagctcctatctgtccccagagagcgtgcttacggctcctactccttcaagtagacctactcaacaagatacagattctgatgacgaacaaccgagtaccagccagcaagatatccgtatgagaaaa

SEQ ID NO: 546 - DNA, 579 bp, C. Trachomatis D serovar
ttgtggttttttttaggctctccgtcagcgattactaattttagcagggtagatgtggctttaaacctaagaataaataggcagatacgagctcctagggtacgtgtaataggttccgcaggagagcagctaggcatattgagtataaaagaggccctagatttagccaaggaagctaatttagaccttgttgaggttgcttcaaactcagagcctcccgtgtgcaaaatcatggactatgggaagtatcgttacgacgtaactaaaaaagaaaaagatagtaagaaagcacagcaccaagtacgtatcaaagaggttaagcttaagcctaatatcgatgataacgactttcttacgaaagcaaagcaagctagagcctttattgagaaaggaaataaagtaaaggtttcttgtatgtttcgggggcgagagttggcttatcccgaacacgggtataaggttattcaaagaatgtgtcagggcttagaggacataggttttgttgagtcagagcctaaactgaatggccgttctttgatctgtgttattgctccgggaacactaaaaactaagaaaaaa

SEQ ID NO: 547 - DNA, 3159 bp, C. Trachomatis D serovar
atgtttacaaggatagttatggtcgatctacaagaaaagcaatgcacaattgttaagcgcaatggaatgtttgttcctttcgatcggaaccgtatttttcaggctttagaagcagcttttcgagacactcgcagaattgatgatcatatgcctttgcctgaagatctggaaagttccatacgctcgataacgcatcaggtagttaaagaagttgtgcaaaagattacagatggacaagtggttactgtagagcgtatccaagatatggttgaaagccaactatatgtgaatggtttgcaagatgttgctcgcgattatattgtctatcgcgatgaccgtaaagcgcatcggaaaaaatcttggcaaagcctatccgttgttcgtcgttgtgggactgttgtacactttaatcctatgaaaatttccgccgctttggaaaaagctttccgagctaccgataagactgaggggatgactccaagttctgtgcgagaggaaatcaatgctttgacgcaaaacattgtcgcggaaatagaagaatgttgtcctcaacaggatagacgcattgatatcgagaagattcaagatattgttgaacagcaactaatggttgttgggcattatgctgttgcaaagaactatattctttatcgagaagctcgcgctcgtgttcgtgataacagagaagaggacgggagtacagaaaagactatagcagaagaagctgttgaggtgctcagtaaagacggttctacctatacaatgacgcattcgcagttgttggctcatttagcgcgcgcttgtagtcgttttccagaaacgacagatgcggcgctgcttaccgatatggctttcgcaaatttctattccggtatcaaagagtctgaagtagtactggcctgtattatggcggctcgtgccaatattgaaaaggagcctgattatgcctttgttgctgcagagctcttacttgacgttgtatataaggaagcgttagggaaatcgaaatatgctgaggatttagaacaagcacatcgcgatcatttcaaacgctacatcgcagaaggggatacctatcgtctgaatgctgaactgaaacatctttttgatttagacgcgttagccgatgctatggatctatctcgagatctacagttttcttacatgggtattcaaaatctgtatgatcgttattttaatcaccacgaaggttgccgtttagaaactccccaaattttttggatgcgcgttgctatggggttggcattgaatgagcaagacaagacttcttgggctattactttttataatttgctttcgacattccgatatacaccagctacgccaaccttgttcaattcaggtatgcggcattctcagttaagctcttgctatctttccactgtacaagataatttggtcaatatctataaggtcattgctgataacgctatgctatctaagtgggcaggagggataggtaatgattggacggcgattcgtgcaacaggggctttaattaaaggaaccaatggaagaagtcagggagtaattccttttattaaggtgacaaatgatacagcagtcgcagtgaatcaaggtggtaaacgcaagggagctgtatgcgtctatttagaagtttggcacctcgactacgaagatttccttgaattgagaaagaatacaggggatgagcgtcgacgggctcatgatgtcaatatagctagctggattccagatcttttcttcaaacgtttacagcaaaaagggacatggactctattcagcccagatgatgttccgggattacacgatgcttatggggaagaatttgagcgtttgtacgaagaatatgagcggaaggttgataccggagagattcggttattcaagaaggtagaagctgaagatctgtggagaaaaatgctcagcatgctttttgaaacgggacacccatggatgacttttaaagatccatccaacatccgttcggctcaagatcataaaggcgtggtgcgttgttccaatctgtgtacggagattttgttaaactgctcggagacagaaactgctgtttgtaatttaggatcgattaacttagttcaacatatcgtaggggatgggttagatgaggaaaaactctctgagacgatctctatagcagtccgtatgttggataacgtgattgatattaacttttatccaacaaaggaagctaaagaggcgaactttgctcaccgcgctattggattaggggtgatgggattccaagatgccttgtataagctagatataagctatgcttcgcaagaagctgtagaatttgctgactacagttcagagttgatttcttactatgcgattcaagcttcttgtctgctcgctaaagaacgaggcacttacagctcttataaaggatcgaaatgggatagaggtttgctccctattgatacgattcagttgttagcgaactatcgaggagaagcaaatctccagatggatacgtcatcaagaaaagattgggaacctatccgtagtttggttaaagagcatggtatgcgacattgtcagcttatggctatagctccgacagcgacgatctccaacattataggagtaactcaatctattgagccaacgtacaaacatttgtttgtgaagtctaatttgtccggagaattcacgattccaaatgtgtatttaattgagaagttgaagaaattaggtatctgggatgctgatatgttagatgacctgaaatattttgatgggtctttattggaaatcgagcgtataccagatcacttaaaacatattttcttgacagcttttgagattgaaccagaatggattatcgaatgcgcgtctcgaagacaaaaatggattgatatggggcaatccctcaacctttatcttgcccagccagacgggaaaaaactgtcgaatatgtatttaacggcttggaaaaaaggtttgaaaactacgtattatctgagatcttcatcagcaacgaccgttgaaaaatcttttgtagatattaataagagaggaattcagcctcgttggatgaagaataagtctgcttcggcaggaattattgttgaaagagcgaagaaagcacctgtctgttctttggaagaagggtgtgaagcatgtcag

SEQ ID NO: 548 - DNA, 1038 bp, C. Trachomatis D serovar
atgcaagcagatattttagatggaaaacagaaacgcgttaatctaaatagcaagcgtctagtgaactgcaaccaggtcgatgtcaaccaacttgttcctattaagtacaaatgggcttgggaacattatttgaatggctgcgcaaataactggctccctacagagatccccatggggaaagacatcgaattatggaagtcggatcgtctttctgaagatgagcggcgagtcattcttttgaatttaggttttttcagcaccgcagagagcttggttgggaataatattgttctagcaatttttaaacatgtaactaatccggaagcgagacaatatcttttaagacaagcttttgaagaagcggttcacacgcacacatttttgtatatttgtgagtcactcggattagacgagaaagaaattttcaatgcctataacgagcgtgctgcgattaaggccaaagatgatttccagatggaaatcactggcaaggtattagatcctaattttcgcacggactctgttgagggtctacaggagtttgttaaaaacttagtaggatactacatcattatggaagggattttcttctatagtgggtttgtgatgatcctttccttccacagacaaaataagatgattggtattggagaacaatatcaatacatcttaagagatgagacaatccacttgaactttggtattgatttgatcaacgggataaaagaagagaacccggagatttggactccagagttacagcaagaaattgtcgaattaattaagcgagctgtcgatttagaaattgagtatgcgcaagactgtctccctagagggattttgggattgagagcttcgatgttcatcgattatgtgcagcatattgcagaccgtcgtttggaaagaatcggattaaaacctatttatcatacgaaaaacccattcccttggatgagcgaaacaatagaccttaataaagagaaaaacttctttgaaacaagggttatagaatatcaacatgcagcaagcttaacttgg

SEQ ID NO: 549 - DNA, 978 bp, C. Trachomatis D serovar
atgtctttttttcatactagaaaatataagcttatcctcagaggactcttgtgtttagcaggctgtttcttaatgaacagctgttcctctagtcgaggaaatcaacccgctgatgaaagcatctatgtcttgtctatgaatcgcatgatttgtgattgcgtgtctcgcataactggggatcgagtcaagaatattgttctgattgatggagcgattgatcctcattcatatgagatggtgaagggggatgaagaccgaatggctatgagccagctgattttttgcaatggtttaggtttagagcattcagctagtttacgtaaacatttagagggtaacccaaaagtcgttgatttaggtcaacgtttgcttaacaaaaactgttttgatcttctgagtgaagaaggattccctgacccacatatttggacggatatgagagtatggggtgctgctgtaaaagagatggctgcggcattaattcaacaatttcctcaatatgaagaagattttcaaaagaatgcggatcagatcttatcagagatggaggaacttgatcgttgggcagcgcgttctctctctacgattcctgaaaaaaatcgctatttagtcacaggccacaatgcgttcagttactttactcgtcggtatctatcctctgatgcggagagagtgtctggggagtggagatcgcgttgcatttctccagaagggttgtctcctgaggctcagattagtatccgagatattatgcgtgtagtggagtatatctctgcaaacgatgtagaagttgtctttttagaggataccttaaatcaagatgctttgagaaagattgtttcttgctctaagagcggacaaaagattcgtctcgctaagtctcctttatatagcgataatgtctgtgataactattttagcacgttccagcacaatgttcgcacaattacagaagaattgggagggactgttcttgaa

SEQ ID NO: 550 - DNA, 438 bp, C. Trachomatis D serovar
atgcaaaatcaatttgaacaactccttactgaattagggactcaaatcaacagccctcttactcctgattccaataatgcctgtatagttcgctttggatacaacaatgttgctgtacaaattgaagaggatggtaattcaggatttttagttgctggagtcatgcttggaaaacttccagagaatacctttagacaaaaaattttcaaagctgctttgtctatcaatggatctccgcaatctaatattaaaggcactctaggatacggtgaaatctctaaccaactctatctctgtgatcggcttaacatgacctatctaaatggagaaaagctcgcccgttacttagttcttttttcgcagcatgccaatatctggatgcaatctatctcaaaaggagcacttccagatttacatgctctaggtatgtatcacctg

SEQ ID NO: 551 - DNA, 1581 bp, C. Trachomatis D serovar
atgccgtcattatcccaatcccgacgtatcatccagcaatcttccattcgaaagatttggaatcagatagatacttctcctaagcatggcgtatgcgtaccgttattttctctctatactcaagaaagttgtgggataggtgaatttcttgacctgattcctatgatcgattggtgtatctcgtgtggttttcaaatccttcaaattcttccgattaacgatacagggtcctgttcgagtccttacaatagcatttcttcgatagcactcaatcctcttcacctttctatctctgcgctcccctataaagaagaagtgccagctgcggaaacacgcatacgagaaatgcagcaactctctcaacttcctcaagtacattatgaaaaagttcgctctatgaagagagatttttttcaagagtactaccgcgtgtgtaaacagaaaaaactcactgatcatcctgatttttatgccttctgtgaacaggaaaaatattggttacatccctacgctctctttcgctctatccgagaacatttggataaccttcctattaatcattggccaaccacctacacagatctctcccagattaccgagcatgaacgtacttttgcggaagatatacaatttcactcttatctacagtatttgtgcttccaacagatgacacaagtgcgggagcatgccaattgcaaaagctgtctcatcaaaggggatatccctattctaatcagtaaagatagctgcgatgtctggttttataggcattacttttcctcttcagaatctgtaggtgctcctcctgacctgtataatgcggaaggtcagaactggcatctccccatttgtaatatgaaaactttgcaacaagataactacctctggtggaaggagcgcttacgttatgcggagaatttttactctttataccgtcttgatcatgtcgtcggtctctttcgattttgggtatgggatgagtctggatgcggacgctttgaacctcatgatccgaaaaactatctagctcaagggcaagatatcttatctcacctcttgaccagttcatctatgctacctataggagaagatctgggaacgatcccttccgatgtgaaacgtatgctcgagtcttttgccgtatgcggcactagaattcctcgttgggaacgaaactgggaggggaatggagcctatacccctttcgatcaatacgaccctctatccgtcacaagcctctctactcatgattcctctacattagcctcatggtggaaagaatctcctcaggaatccaaactatttgctcagtttttaggactcccctattcttccaccctatctcttcacaatcataccgaaatcctgaaactctctcacaaaacctcttctatttttcgcatcaatcttattaatgactatctggctctgttcccggatttgatatcaaaaactcctcgctacgaaagaatcaatctgccaggaactatttcaaaaaataattgggtgtatcgagttaagccttctattgaagatttatcctctcattctaagctaaattctttacttgaggctctattt

SEQ ID NO: 552 - DNA, 1950 bp, C. Trachomatis D serovar
atgaccatccctattcatgagaataaatattccatgatctccttcacacgcacgataggttttcgtttatggcttatctgtgtggccgctattatgttccccttagggatcaatatcttgcaattgaaccttcagcaatacaagaaaacactctcctctatcacttccgatctgcgagaaaatgctttatttaaagctcacactttacaacaaactattcctttaaatattgatatcctggctctcttttcagaaatttttgatctagacagaggagtccctgctgaaccggatcttgctctaagtaaagaaatggagaagatctttcactccacttataaagagatttctctagtaaaaaaagaggctgatgggaactttagagtcgttgcttctagccgcatcgaacaacttggtaaaaactataaccaagagattttcctatcagattctcaaccatttctcgctactttgcgacattccggttccgattctcaggttctggctgtcttacaaacgaatatttttgatatcagctctcaagaagtccttggcgtactctataccctttcggataccaactatttattaaatggattacttgcagctaaagatcctctctccgtaaaaactgcaattctctctaaaaatggcatcattcttcaagcaacagattcctctttagatcttgtatcgatacacaaaacggtttctaaagagcaattttgtgatgttttccttcgcgatgatatctgcccccctcatctcttactacgcccccctttaaatctcgatcctcttccttatggcgagaatttcgtttcattttgcattgggaacacagaaatgtggggatatatccactctctacctgagatggatttccgtatattgacttatgaagaaaaatctataatttttgcttctttatggcgacgaaccttactgtactttgcttatttttgttgcgtacttttaggaagcattacagcttttttagttgcaaaacgcctatccaagcctatccggaagctggctacggccatgatggaaactcgtcgcaatcaacaccatccatatgaacccgattctctgggctttgaaattaatcatctaggagaaatctttaactccatggtgcaaagccttttgcaacagcaatctttagcagaaaaaaatttcgagatcaaacagcatgcacaaaatgcattacgactaggagaagaagctcaacaatgcctgcttcctaaccagctgcctgattccccaactacagaaatcgctaaagcctatattcctgcaattacggtaggaggagatttctttgatatctttgttataggcgaaggtccccaagctaaactctttctaatcgttgctgatgcttccgggaaaggagtcaatgcgtgcgcctactccttattcctgaaaaacatgttacatacctttttgagtgagctctcctctattcaagaagccgttcaacaaacagctgctctcttctatcaacagacagctgaatctgggatgtttgtaacactatgcatttattgttatcattacgcaacacgagaactagaatactattcttgtggccacaacccagcgtgtctccgagctcctaatggagatatctctttcctgtcgcatcctggtatggccttaggatttttacctgaagttcctcctcaccctgcttacactctcgttcttgaagaggagtctcttttagtgctctataccgatggggtgactgaagcaagcaataagcatggagagatgtttggagaagaacgcttaaaagcattagtggcttcgttgacgaaacaaagtgccgaagaagccatccaatctatcatgttctctattaagtcttttgtgaaagattgcccacaacatgacgatatcactttactcgttttgaaaatacctaaggaaccttccgcttat

SEQ ID NO: 553 - DNA, 939 bp, C. Trachomatis D serovar
atgctcagctacataaagaggcggctgttgtttaatttgctttctttatgggtagtagtgactctaacgttttttattattaagacgatccccggagatccttttaatgatgaaaacggaaacatcctttcgtcagaaactttagcactattaaagaatcgttacgggttagataagcctttattcacccagtatcttatctatttgaaatgtctgctaacactagatttcggggaatctcttatctacaaagatcgtactgtgatcagtattattgctgccgctcttccatcttccgctattcttggacttgaaagcttgtgtttatccctcttcggaggcattactcttggaattctggcagctttctataaaaaaagctgcggccgaactattttcttttcttctgtgattcagatatcagtacccgcctttgttataggagcctttttacaatatgtttttgctataaaatattcttgtctacccatagcttgctggggaaatttctctcacaccttattgccctcaatagctttagcaattactcctatggcattcattactcagctaacctgtgcctctgtttccgccaatttaaaaaaagattacgtcttattagcttacgctaaaggactttctccttttaaggtgttaataaaacacattttgccctacgctttattccctgtgatttcgtactcagcttttcttataacaactttaatgactggaaccttctctatagaaaaccttttctgcatccccggtcttgggaaatggttcatttgcagtattaaacaaagagactaccctatcaccttaggactttctgtgttttacggggcctttttcatgctaacttcactttgttgcgaccttctgcaagcgtggatagatccacaaattcgttattcttatgggaaagaacgttctaaa

SEQ ID NO: 554 - DNA, 3711 bp, C. Trachomatis D serovar
ttgacctggattccattacattgccactctcagtattccatcttggatgcaacatgctcaatcaagaagtttgttgccaaagcagtggaatatcaaattcccgcgctcgctcttaccgatcacgggaatttgtttggcgcggtcgaattttataagacctgtaaacaaaacgcgattaaacctatcatcgggtgtgagctatacgtcgcaccctcttctcgtttcgataaaaaaaaagaacgaaaaagccgagttgccaaccatctcatccttctttgtaaagatgaagaagggtatcgcaacctttgtttgctctcctctcttgcttacacagaaggtttttactatgtgcctcgcatagatagagatcttttgagccaacactccaaaggacttatctgcttatcagcctgtttatccggatcggttgctcaagctgcattggaatctgaagaagatttagaaaaagatcttttatggtatcaagatctgtttcaagaagactttttcagtgaagtacaactccacaaatcctcagaagaaaaagttgctctatttgaagaaacttggttaaaacaaaactactatcaattcattgagaaacaactcaaagtaaatgaagctgttttagctacttctaaacgccttggtattccttcagttgctacaaatgatattcactatttgaatccggacgattggctcgctcatgaaattttactcaatgttcagtctagagagcctattcggacagctaaacaaaatacttacattcccaatcctaaacgcaaaacctatcctagtagggaattttattttaaatcccctcaagagatcgcagagctatttgcagcacatccagagactattaccaatacgtgtatcgttgccgagcgctgccacctagagcttgattttgaaaccaaacactatcctatctacgtcccagaagctttacaaaaaaaaggatcctacacagaagaggagcgctacaaagcatcctcagccttcttagaagaactttgcgagcaaggattaaccagcaaatacacacccgagcttctaggacacattgcaaagaaattccctggggaagaccctcttacgctggttaaagaacgtctcaaattggaatcctctattattatctccaaagggatgtgcgattacttgctcattgtctgggatattattaactgggcaaaagatcatgggattcctgttggccccggtcgaggctctggagcgggctctgtcatgcttttccttctggggattactgaaatagaaccgattcgcttcgaccttttcttcgaacgtttcatcaacccggaacggatatcgtatcccgatatcgatatcgatatctgtatgattggcagagagcgcgttattaactatgctatagaacgtcatggtaaagataatgtagcccaaattattacatttggcaccatgaaagccaaaatggctattaaggatgtgggtagaactttagatacccccttagctaaagtgaacttcatcgcgaaacatattcccgatcttaatgctaccattacttcggcattagaggctgatccagaattaaggcaactgtatgtagatgacgctgaagctgcagaagttattgatatggctaaaaaactagagggatctatccgcaatactggagtgcatgctgcgggagtgattatctgtggagatcctctcactaaccatatcccgatttgtgtccctaaagactcatccatgatttctactcagtactcaatgaagccagtagaaagcgttggcatgcttaaagtggattttttgggtctaaaaaccttaaccggcattcacatcgccacacaggcgatctataaaaaaacaggcattctactccgggctgccacgattcctctagatgaccagaatactttctctcttcttcatcaaggtaaaaccatggggatcttccaaatggaatctcgtggcatgcaagaccttgctaaaaacttacgcccagatgcgtttgaagaaattatagcgatcggagccctctatcgccctggccctatggatatgatcccatcatttatcaataggaagcatggtaaagagaatattgaatacgaccatcctctcatggaacctattctaaaagaaacttttggaattatggtttaccaagaacaagtcatgcagattgccggttcattagcaaaatactctttgggagaaggggatgttttacgccgcgctatggggaaaaaagaccatgaacagatggtcaaggaacgagagaaattttgttcaagagccgcagcgaatggcatcgacccttccatagcaacgactatcttcgataagatggaaaagtttgcttcctatggatttaataagtcccatgccgcagcttacggtcttataacctacacaacagcatatcttaaagccaactaccccaaagaatggcttgccgcccttctcacttgcgattatgacgatattgagaaagttgggaagctaattcaagaagctcacagtatgaacattctcgttctgcctcctgatattaatgagtctggacaagattttgaagccactcagaaagggattcgcttttctctaggagctgtcaaaggcgttggaatgagcattgtggatagtattgttgaagagagagaaaaaaacggcccctataaaagtctgcaggatttcgttcaacgcgcagattttaaaaaagtcactaagaaacagcttgaaaatttggtggatgcaggaacctttgactgcttcgaacctaataaagatcttgcgctggcaatccttaatgacctttacgacacgttctctagagaaaaaaaagaagctgctacaggagtcctaacctttttttcactagatagcatggctagagatcctgttaaaattactgtctctcctgaaaatgttatccaacgctctcctaaggagttgttgaaaagagaaaaagaattacttggagtatatttgactgcccatcctatggatgctgttgaacacatgctccctttcttatctgtagtcccagctcgagattttgaaggactccctcatggaaccattattcgtacagtctttctaatcgataaagtcactactaaaatttcctctgcagagcagaaaaaatttgcacttttacaagtcagcgatgaagtcgattcatatgaacttccaatctgggccgatatgtacgccgaataccgtgatctattggaagaagatcgtcttatttatgccattttggctatagatcgacgtagtgattccttgcgtctatcttgtcggtggatgcgagacttatctaccgttaatgattcagtaattgcggaatgcgacgaagtctatgatcgactgaaaagtcagaaagtatactcttcaacgaaaaaatcaaccggagcccagtcctcagcaatgataaagaaagtagagactagagagatctctcccgtaaccatctctttagatttaaataaattacgccatagccacttatttattctcaaagggctgatacgcaaatattctggatctcaagcactctctcttgtattcacaaaagataatcagcggttcgcctctatctctccagatgcagattttttcgtaacagatgatatctcttctcttcttcaagaaattgaagcaaccaatatccctgctcgcgttctagccactacagta

SEQ ID NO: 555 - DNA, 1689 bp, C. Trachomatis D serovar
atggtttattttagagctcatcaacctaggcatacgcctaaaacatttcctttggaagttcaccattcgttctccgataagcatcctcaaattgctaaagctatgcggattacggggatagccctcgcagctctatctctgctcgctgtagtcgcctgcgttattgccgtctctgcgggaggagctgccattcctcttgctgtcattagtggaattgctgtaatgtctggcctcttatccgctgccaccattatctgttctgcaaaaaaggctttggctcaacgaaaacaaaaacaactagaagagtcgcttccgttagataatgcgaccgagcatgtgagttacctgacctcagacacctcttattttaatcaatgggaatccttaggtgctctaaataagcagttgtctcagattgacttaactattcaagctcccgaaaaaaaactattaaaagaagttcttggttccagatacgattccattaatcactccatcgaagagatctccgatcgctttacgaaaatgctctctcttcttcgattaagagaacatttttatcgaggagaagagcgttatgccccctatttaagccctcctctacttaacaagaatcgtttgctgacccaaatcacatccaatatgattaggatgctaccaaaatccggtggtgttttttccctcaaagccaatacactaagtcatgccagccgcacactatatacagtattaaaagtcgctttatccttaggagttctcgctggagtcgctgctcttatcatctttcttccccctagcctgccttttatcgctgttataggagtatcttccttagcattggggatggcatctttccttatgattcggggcattaagtatttgctcgaacattctcctctgaatagaaagcaactagctaaagatattcaaaaaaccattggcccagatgtcttggcctctatggttcattaccagcatcaattactatcacatctacatgaaactctattagatgaagccatcacagctagatggagcgagcccttctttattgaacacgctaatcttaaggcaaaaattgaagatttgacaaaacaatatgatatattgaacgcagcctttaataaatctttacaacaagatgaggcgctccgttctcaattagagaaacgagcttacttattcccaattcctaataacgacgaaaatgctaaaactaaagaatcgcagcttctagactcagaaaatgattcaaattctgaatttcaggagattataaataaaggactagaagctgccaataaacgacgagctgacgctaagtcaaaattctatacggaagacgaaacctctgacaaaatattctctatatggaaacccacaaagaacttggcattagaagatttgtggagagtgcatgaagcttgcaatgaagagcaacaagctctcctcttagaagattatatgagttataaaacctcagaatgtcaagctgcactccaaaaagtgagtcaagaactgaaggcggcacaaaaatcattcgcagtcctagaaaagcatgctctagacagatcttatgaatccagtgtagccacgatggatttagctagagcgaatcaagaaacacaccggcttctgaacatcctctctgaattacaacaactagcacaatacctgttagataatcac

SEQ ID NO: 556 - DNA, 5253 bp, C. Trachomatis D serovar; identical to SEQ ID NO: 421

SEQ ID NO: 557 - DNA, 792 bp, C. Trachomatis D serovar
atgggaaattctggtttttatttgtataacactgaaaactgcgtctttgctgataatatcaaagttgggcaaatgacagagccgctcaaggaccagcaaataatccttgggacaaaatcaacacctgtcgcagccaaaatgacagcttctgatggaatatctttaacagtctccaataattcatcaaccaatgcttctattacaattggtttggatgcggaaaaagcttaccagcttattctagaaaagttgggaaatcaaattcttgatggaattgctgatactattgttgatagtacagtccaagatattttagacaaaatcacaacagacccttctctaggtttgttgaaagcttttaacaactttccaatcactaataaaattcaatgcaacgggttattcactcccagtaacattgaaactttattaggaggaactgaaataggaaaattcacagtcacacccaaaagctctgggagcatgttcttagtctcagcagatattattgcatcaagaatggaaggcggcgttgttctagctttggtacgagaaggtgattctaagccctgcgcgattagttatggatactcatcaggcgttcctaatttatgtagtctaagaaccagcattactaatacaggattgacaccaacaacgtattcattacgtgtaggcggtttagaaagcggtgtggtatgggttaatgccctttctaatggcaatgatattttaggaataacaaatacttctaatgtatcttttttggaagtaatacctcaaacaaacgct

SEQ ID NO: 558 - DNA, 306 bp, C. Trachomatis D serovar
atgcaaaataaaagaaaagtgagggacgattttattaaaattgttaaagatgtgaaaaaagatttccccgaattagacctaaaaatacgagtaaacaaggaaaaagtaactttcttaaattctcccttagaactctaccataaaagtgtctcactaattctaggactgcttcaacaaatagaaaactctttaggattattcccagactctcctgttcttgaaaaattagaggataacagtttaaagctaaaaaaggctttgattatgcttatcttgtctagaaaagacatgttttccaaggctgaa

SEQ ID NO: 559 - DNA, 729 bp, C. Trachomatis D serovar
gtgggatgcaacttggcccaatttttagggaaaaaagtgttacttgctgacctagacccgcaatccaatttatcttctggattgggggctagtgtcagaaataaccaaaaaggcttgcacgacatagtatacaaatcaaacgatttaaaatcaatcatttgcgaaacaaaaaaagatagtgtggacctaattcctgcatcatttttatccgaacagtttagagaattggatattcatagaggacctagtaacaacttaaagttatttctgaatgagtactgcgctcctttttatgacatctgcataatagacactccacctagcctaggagggttaacgaaagaagcttttgttgcaggagacaaattaattgcttgtttaactccagaacctttttctattctagggttacaaaagatacgtgaattcttaagttcggtcggaaaacctgaagaagaacacattcttggaatagctttgtctttttgggatgatcgtaactcgactaaccaaatgtatatagacattatcgagtctatttacaaaaacaagcttttttcaacaaaaattcgtcgagatatttctctcagccgttctcttcttaaagaagattctgtagctaatgtctatccaaattctagggccgcagaagatattctgaagttaacgcatgaaatagcaaatattttgcatatcgaatatgaacgagattactctcagaggacaacg

SEQ ID NO: 560 - protein, 289 aa, C. Trachomatis D serovar
MTHQHKKISEETIACDMLERYTGSTVQEFQPYLLLTNFAYYVDVFAEIYQVPVSRGSMFSAAHAPQIHTSIIDFKLGSPGAALTVDLCSFLPNATAAIMLGMCGGLRSHYQIGDYFVPVASIRKDGTSDAYFPPEVPALANFVVQKMITNILEAKNLPYHIGITHTTNIRFWEFNKEFRRKLYENKAQTVEMECATLFAAGYRRNLPLGALLLISDLPLRKDGIKTKESSSAVLNSHTKEHILTGVEVFASLQEKSGPGIKKTKGLPHMEFGQADDSLSEQTEVSGGDF

SEQ ID NO: 561 - protein, 394 aa, C. Trachomatis D serovar
MSKETFQRNKPHINIGTIGHVDHGKTTLTAAITRALSGDGLADFRDYSSIDNTPEEKARGITINASHVEYETANRHYAHVDCPGHADYVKNMITGAAQMDGAILVVSATDGAMPQTKEHILLARQVGVPYIVVFLNKIDMISEEDAELVDLVEMELVELLEEKGYKGCPIIRGSALKALEGDAAYIEKVRELMQAVDDNIPTPEREIDKPFLMPIEDVFSISGRGTVVTGRIERGIVKVSDKVQLVGLRDTKETIVTGVEMFRKELPEGRAGENVGLLLRGIGKNDVERGMVVCLPNSVKPHTQFKCAVYVLQKEEGGRHKPFFTGYRPQFFFRTTDVTGVVTLPEGIEMVMPGDNVEFEVQLISPVALEEGMRFAIREGGRTIGAGTISKIIA

SEQ ID NO: 562 - protein, 550 aa, C. Trachomatis D serovar
MESSRILITSALPYANGPLHFGHITGAYLPADVYARFQRLQGKEVLYICGSDEYGIAITLNAELAGMGYQEYVDMYHKLHKDTFKKLGISVDFFSRTTNTYHPAIVQDFYRNLQERGLVENQVTEQLYSEEEGKFLADRYVVGTCPKCGFDRARGDECQQCGADYEARDLKEPRSKLTGAALSLRDTEHAYLHLERMKEDLLAFVQGIYLRPHMRNFVTDYIEHLRPRAVTRDLSWGIPVPDLENKVFYVWFDAPIGYISGTMDWAASIGDPEAWKKFWLDDTVTYAQFIGKDNTSFHAAIFPAMEIGQSLPYKKVDALVTSEFLLLEGFQFSKSDGNFIDMDAFLETYSLDKLRYVLAAIAPETSDSEFSFQEFKTRCNSELVGKYGNFVNRVLAFAVKNGCTELSSPQLEQKDLDFISKSQKLAKDAAEHYAQYSLRKACSTIMELAALGNGYFNDEAPWKLAKEGNWNRVRAILFCACYCQKLLALISYPIMPETALKILEMIAPHSLDLGSQDPDRLQSLWTDSFFDYSEEKFSLKEPELLFTMVE

SEQ ID NO: 563 - protein, 100 aa, C. Trachomatis D serovar
MARKDRLTNERLNKLFDSPFSLVNYVIKQAKNKIARGDVRSSNVAIEALNFLDLYGIQSEYAERDDRERHLSATGERRREQGFGTSRRKDPSLYNWSDVK

SEQ ID NO: 564 - protein, 205 aa, C. Trachomatis D serovar
MSVKVISPFSQDGVQCFPKLFIISAPAGAGKTTLTHMLQREFPDAFEKTVSSTTRSARPGEVHGVDYLFVSEDDFKQSLDREDFLEWVFLFGTYYGTSKAEISRVLQKGKHCIAVIDVQGALALKKQMPAVTIFIQAPSQEELERRLNARDSEKDFQKKERLEHSAVEIAAASEFDYVVVNDDLITAYQVLRSIFIAEEHRMSHG

SEQ ID NO: 565 - protein, 602 aa, C. Trachomatis D serovar
MKPYKIENIRNFSIIAHIDHGKSTIADRLLESTSTIEQREMREQLLDSMDLERERGITIKAHPVTMTYEYEGETYELNLIDTPGHVDFSYEVSRSLAACEGALLIVDAAQGVQAQSLANVYLALERDLEIIPVLNKIDLPAAQPEAIKKQIEEFIGLDTSNTIACSAKTGQGIPEILESIIRLVPPPKPPQETELKALIFDSHYDPYVGIMVYVRVISGEIKKGDRITFMATKGSSFEVLGIGAFLPEATLMEGSLRAGQVGYFIANLKKVKDVKIGDTVTTVKHPAKEPLEGFKEIKPVVFAGIYPIDSSDFDTLKDALGRLQLNDSALTIEQENSHSLGFGFRCGFLGLLHLEIIFERISREFDLDIIATAPSVIYKVVLKNGKTLFIDNPTAYPDPALIEHMEEPWVHVNIITPQEYLSNIMSLCMDKRGICLKTDMLDQHRLVLSYELPLNEIVSDFNDKLKSVTKGYGSFDYRLGDYKKGAIIKLEILINDEAVDAFSCLVHRDKAESKGRSICEKLVDVIPPQLFKIPIQAAINKKIIARETIRALAKNVTAKCYGGDITRKRKLWDKQKKGKKRMKEFGKVSIPNTAFVEVLKME

SEQ ID NO: 566 - protein, 324 aa, C. Trachomatis D serovar
MELLPHEKQVVEYEKTIAEFKEKNKENSLLSSSEIQKLDKRLDRLKEKIYSDLTPWERVQICRHPSRPRTVNYIEGMCEEFVELCGDRTFRDDPAVVGGFAKIQGQRFMLIGQEKGCDTKSRMHRNFGMLCPEGFRKALRLAKMAEKFGLPIIFLVDTPGAFPGLTAEERGQGWAIATNLFELARLATPIIVIVIGEGCSGGALGMAIGDVVAMLEHSYYSVISPEGCASILWKDPKKNSDAAAMLKMHGEDLKGFAIVDAVIKEPIGGAHHNPAATYRSVQEYVLQEWLKLKDLPVEELLEKRYQKFRTIGLYETSSESDSEA

SEQ ID NO: 567 - protein, 646 aa, C. Trachomatis D serovar
MKLLLKAILRHKKHLVLFGFSLLSILGLTITSQAEIFSLGLIAKTGPDTFLLFGKQEGASLVKRKELSKDQLLEQWDNIVGEGDTLSLPQANAYIAKHSGGSQSITKRLSAYLSGCFDFSRLQCLALFLVVVAILKSTTLFFQRFLAQLIAIRVSCSLRKDYFLALQTLPMTFFHAHDMGNLSSRVIADSSMIALAINALMVNYIQAPITMTLALVVCLSISWKFCACVCLAFPIFILPIVIIAKKVKALAKRIQKSQDHSAAALLDFLLGILTVKVFRTEQFSFSKYCQKNDEIARLEERSAAYSLIPRPLLHTIASLFFALVIMIGLYHFHIPPEELVVFCGLLYLIYDPIKKFADENANIMWGCAAAERFYEVLDLAKQQSNVSEKLNEFQGLQHSIQFCNVSFGYVEDSPVLSDFNLVLKKGEAIGIVGPTGSGKSTIAKLLPRLYEVSHGELLIDSLPIRSYCKNSLRKHIGCVLQHPFLFYDTVWNNLTCGRTFSEEEVFHALKQAHAYEFVSKMPQGVHSLLEESSKNLSGGQQQRLTIARALLHNTSILLLDEATSALDAISENYVKEIVGQLKGRCTQIIIAHKLSTLEYVDRIVYLEQGKKIAEGTKEELLDSCPAFQRMWVLSGAKDWELNAVVK

SEQ ID NO: 568 - protein, 414 aa, C. Trachomatis D serovar
MFSSAIVILTAIFVLCSGFVSLSHIALFSLPSSLIAHYSHSKNRQLRQIANLMAYPNHLLMTLVFFDIGINIGVQNCIATLVGDSASLLLTVGVPLALTLVLGEIVPKVIAIPYNARIAKIVTPIIFASTKSFRPIFDWAISGINFIVQKMLARQESDFIQPQELKEVLRSCKDFGVVNHEESRLLFGYLSMEEGSIKERMTPKQEIIFYDVLTPIENLYKLFSGPKQSYSKVLVCKGGLQNLLGVCSAKLLLLYKEKLQSAEELLPLLRKPHYIPETVSAKTALYHLAGEDCGLGIIIDEYGSIEGLITQNDLFKIVSDGVAHNRPSFKQFAHSDKNVVIAAGTYELSDFYDLFGVDLPTTANCVTIGGWLTEQLGEIPETGTKFAWGQFVFQILDAAPNCVKRVYIRKTHGN

SEQ ID NO: 569 - protein, 404 aa, C. Trachomatis D serovar
METNSPFFWLGVNLLCIFVQGFFSMMEMACISFNRVRLQYYLTKSNKKASYINFLVRRPYRLFGTVMLGVNIALQIGSESSRTCYKLLGISPEYAPATQIILVVIFAELIPLAISRKIPEKIALKGAPILYFAHYLFYPLIQCVGGITNMIYFILNIKEETLHSTLSRDELQKTLETHHEEHDFNVIATNIFSLSATSVEQVCQYLDQIPILSATASVRDVCQLVRRHRLDFVPVYHKVKKNVVGIAFPKNLINRNPSDPVVPYLSSPWFITAKSKLIHAIQEFRKNSSNVAIVLNNNGEPMGVLGLHTVFKTLFNTRNIAQLKPKPTSLIERTFSGNTPLSEIENELDIIFMDNDCTTIEQLMLKLLDTPPEVGASIIINDLLLEVKEISLYGIKTVAIKDTL

SEQ ID NO: 570 - protein, 539 aa, C. Trachomatis D serovar
MCCVDGSNSIQQRMRFCEYRTAAQEAKTSLSSDCSLLEARLALRALAKHHEYSAWREAFLRSQERFPSLEADRDIHEDLAASLLQKNIRHSSLTVRVITILAVGMARDYRLVPIVLQALSDDSDTVREIAVQVAVMYGSSCLLRAVGDLAKNDSSIQVRITAYRAAAVLEIQDLVPHLRVVVQNTQLDGTERREAWRSLCVLTRPHSGVLTGIDQALMTCEMLKEYPEKCTEEQIRTLLAADHPEVQVATLQIILRGGRVFRSSSIMESVQKLACNSLSARVQMQAAAILYLEGDPFGEDKLTEGLSATSSILCEAASEAVCSLGIHGVHLAGRFLSKVQGMRSRVNLAFALLVSREKVEEAGDVVASFIHRIEPCRAIEQFLCEDQKIFVASSPLQVEIMKRDLAKKIIRLLVAAQYSKAKMVVAQYLAGQQVGWSFCSEVFWEEGDSEDFVEPLQEESFAFALEKALSFLQREGGEAGLHAVISLYPHSRWQDKLTILEAIAYSENRIATCFLRERCLQEAASLQSAAAGAVFALFK

SEQ ID NO: 571 - protein, 104 aa, C. Trachomatis D serovar
MQTSRISSFFRGLVHLYRWAISPFLGAPCRFFPTCSEYALVALKKHPLRKSLFLIAKRLLKCGPWCIGGIDLVPRTSVEEYLSSPTPLAESPDDRTVPHTQETS

SEQ ID NO: 572 - protein, 336 aa, C. Trachomatis D serovar
MQLFFGRFYEVACIVASILRERDVGVFMGIEGRGSGAMQSKKTIKWLKQALVLSSIVNILLLLLIYSTVFRKDIYKLRVFPGNLIAKSSRIGKIPEDILERLENASFADLLALLQEERMVFGHPLKSWALGVSIQKYFVDIAPMLTHPLTFIRLKSPERTWLLPDINDQEFTRICQYLLTERFPFSSRGFFRIMVRDCEAGMVDEDVLYRFCHLPEFLYVRSLLFGAEIEAASVASLARMIIQGGEDLFFSLCCLENRQTAISDHQRRCFLKAYVDRQEPLAALLLLVHDADWVLHEFSDSDLQSFIQLLPREAHYTKKFLGCVAQSCRLGILLEG

SEQ ID NO: 573 - protein, 426 aa, C. Trachomatis D serovar
MYVRSIFFSIIAFLTVGCSFSPPESGLIIAIHDDPRSLSPEKGENAFHFSLSKALFATLFREELSGLTPALVSSYQVSEDGRFYRFCIRKDAKWSDGSLLLAEDVIAAWEHTKQAGRYSLLFEKLSFRASSSSEILIELKEPEPQLLAILASPFFAVYRPENPFLSSGPFMPKTYVQGQTLVLQKNPYYYDHAHVELHSIDFRIIPNIYTALHLLRRGDVDWVGQPWHQGIPFELRTTSALYTHYSVDGTFWLILNPKDPVLSSLSNRQRLIAAVQKEKLVKQALGTQYRVAESSPSPEGIIAHQEASTPFPGKITLIYPNNITRCQRLAEVLQEQCRDAGIQLTLEGLEYHVFVQKRATQDFSVSTATSIAFHPLAKSKFDQTALDNFTCLPLYHIEYDYILSRPLDQIVHYPSGSVDLTYAHFH

SEQ ID NO: 574 - protein, 605 aa, C. Trachomatis D serovar
MQNILRTSSCRYMFLLGIRSVWNRVAVVNNFRGSSWKIVAIPSCILFTLIFHLPRWLIDFGVCTNLACSLSIIFWVFSLRSSASARIFPSLLLYLCLLRLGLNLASTRWILSSGWASPLIFALGNFFSLGSIPVALTVCLLLFLVNFLVITKGAERIAEVRARFSLEALPGKQMSLDADIAAGRIGYSRASVKKSSLLEESDYFSAMEGVFRFVKGDAIMSWVLLGVNILAALFLGRATHVGDLWLTVLGDALVSQIPALLTSCAAATLIAKVGEKESLAQHLLDYYEQSRQSFLFIALILCGMACIPGAPKALILGFSVLLFLGYKNPSSGETLLFQKERVEFVLPDEGVGNPANLYKDARNQIYQELGVVFPEAIVVRHVTGSSPRLIFSGQEVALRELSCPAILESIRQLAPETISERFVTRLVDEFREHAFLSIEEILPLKISENSLIFLLRALVRERVSLHLFPKILEAIDVYGSQPKNSQELVECVRKYLGKQIGLSLWNRQDVLEVITIDSLVEQFVRDSQEKVVLDLNEKVVAQVKHLLRVGEGNFRAIVTGSETRKELKRIVDPYFPDLLVLAHSELPEEIPITLLGAVSDEVLLS

SEQ ID NO: 575 - protein, 173 aa, C. Trachomatis D serovar
MKKFLLLSLMSLSSLPTFAANSTGTIGIVNLRRCLEESALGKKESAEFEKMKNQFSNSMGKMEEELSSIYSKLQDDDYMEGLSETAAAELRKKFEDLSAEYNTAQGQYYQILNQSNLKRMQKIMEEVKKASETVRIQEGLSVLLNEDIVLSIDSSADKTDAVIKVLDDSFQNN

SEQ ID NO: 576 - protein, 354 aa, C. Trachomatis D serovar
MSQSTYSLEQLADFLKVEFQGNGATLLSGVEEIEEAKTAHITFLDNEKYAKHLKSSEAGAIIISRTQFQKYRDLNKNFLITSESPSLVFQKCLELFITPVDSGFPGIHPTAVIHPTAIIEDHVCIEPYAVVCQHAHVGSACHIGSGSVIGAYSTVGEHSYIHPRVVIRERVSIGKRVIIQPGAVIGSCGFGYVTSAFGQHKHLKHLGKVIIEDDVEIGANTTIDRGRFKHSVVREGSKIDNLVQIAHQVEVGQHSMIVAQAGIAGSTKIGNHVIIGGQAGITGHICIADHVIMMAQTGVTKSITSPGIYGGAPARPYQEIHRQVAKVRNLPRLEERIAALEKLVQKLEALSEQH

SEQ ID NO: 577 - protein, 421 aa, C. Trachomatis D serovar
MTASGGAGGLGSTQTVDVARAQAAAATQDAQEVIGSQEASEASMLKGCEDLINPAAATRIKKKGEKFESLEARRKPTADKAEKKSESTEEKGDTPLEDRFTEDLSEVSGEDFRGLKNSFDDDSSPDEILDALTSKFSDPTIKDLALDYLIQTAPSDGKLKSTLIQAKHQLMSQNPQAIVGGRNVLLASETFASRANTSPSSLRSLYFQVTSSPSNCANLHQMLASYLPSEKTAVMEFLVNGMVADLKSEGPSIPPAKLQVYMTELSNLQALHSVNSFFDRNIGNLENSLKHEGHAPIPSLTTGNLTKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSP

SEQ ID NO: 578 - protein, 231 aa, C. Trachomatis D serovar; identical to SEQ ID NO: 437

SEQ ID NO: 579 - protein, 243 aa, C. Trachomatis D serovar
MKITPIKTRKVFAHDSLQEILQEALPPLQERSVVVVSSKIVSLCEGAVADARMCKAELIKKEADAYLFCEKSGIYLTKKEGILIPSAGIDESNTDQPFVLYPKDILGSCNRIGEWLRNYFRVKELGVIITDSHTTPMRRGVLGIGLCWYGFSPLHNYIGSLDCFGRPLQMTQSNLVDALAVAAVVCMGEGNEQTPLAVIEQAPNMVYHSHPTSREEYCSLRIDETEDLYGPFLQAVTWSQEKK

SEQ ID NO: 580 - protein, 383 aa, C. Trachomatis D serovar
MLPHQQNSSSERARHHESRSHRHSSSSRHHVTRSQSSALPQLQERPVPHPLAERELIIFHSVHQQQNNNPLRMICDTIRQAQRGIFMRIYTISSDDIIQSLIQTSHHVPVEVKYHCGESLPVACQNSRVVLRLTNGRTLQHKKTMLADFQTVVTGSANYTDLSLNHDANVTACIESSELHDAVFSERPQLVHVGPQLLNYIPIQRLIPNAASKMILNAINQATDSIFVLMYIFLSPEFFLALAQAMRRGVRVKVIIDNHSKQDTCKLLSKLGIQLPIYERKTEGVLHTKICCIDNKTLIFGSANWSGAGMIKNFEDLFILRPITETQLQAFMDVWSLLETNSSYLSPESVLTAPTPSSRPTQQDTDSDDEQPSTSQQDIRMRK

SEQ ID NO: 581 - protein, 193 aa, C. Trachomatis D serovar
MWFFLGSPSAITNFSRVDVALNLRINRQIRAPRVRVIGSAGEQLGILSIKEALDLAKEANLDLVEVASNSEPPVCKIMDYGKYRYDVTKKEKDSKKAQHQVRIKEVKLKPNIDDNDFLTKAKQARAFIEKGNKVKVSCMFRGRELAYPEHGYKVIQRMCQGLEDIGFVESEPKLNGRSLICVIAPGTLKTKKK

SEQ ID NO: 582 - protein, 264 aa, C. Trachomatis D serovar
MGNSGFYLYNTENCVFADNIKVGQMTEPLKDQQIILGTKSTPVAAKMTASDGISLTVSNNSSTNASITIGLDAEKAYQLILEKLGNQILDGIADTIVDSTVQDILDKITTDPSLGLLKAFNNFPITNKIQCNGLFTPSNIETLLGGTEIGKFTVTPKSSGSMFLVSADIIASRMEGGVVLALVREGDSKPCAISYGYSSGVPNLCSLRTSITNTGLTPTTYSLRVGGLESGVVWVNALSNGNDILGITNTSNVSFLEVIPQTNA

SEQ ID NO: 583 - protein, 1053 aa, C. Trachomatis D serovar
MFTRIVMVDLQEKQCTIVKRNGMFVPFDRNRIFQALEAAFRDTRRIDDHMPLPEDLESSIRSITHQVVKEVVQKITDGQVVTVERIQDMVESQLYVNGLQDVARDYIVYRDDRKAHRKKSWQSLSVVRRCGTVVHFNPMKISAALEKAFRATDKTEGMTPSSVREEINALTQNIVAEIEECCPQQDRRIDIEKIQDIVEQQLMVVGHYAVAKNYILYREARARVRDNREEDGSTEKTIAEEAVEVLSKDGSTYTMTHSQLLAHLARACSRFPETTDAALLTDMAFANFYSGIKESEVVLACIMAARANIEKEPDYAFVAAELLLDVVYKEALGKSKYAEDLEQAHRDHFKRYIAEGDTYRLNAELKHLFDLDALADAMDLSRDLQFSYMGIQNLYDRYFNHHEGCRLETPQIFWMRVAMGLALNEQDKTSWAITFYNLLSTFRYTPATPTLFNSGMRHSQLSSCYLSTVQDNLVNIYKVIADNAMLSKWAGGIGNDWTAIRATGALIKGTNGRSQGVIPFIKVTNDTAVAVNQGGKRKGAVCVYLEVWHLDYEDFLELRKNTGDERRRAHDVNIASWIPDLFFKRLQQKGTWTLFSPDDVPGLHDAYGEEFERLYEEYERKVDTGEIRLFKKVEAEDLWRKMLSMLFETGHPWMTFKDPSNIRSAQDHKGVVRCSNLCTEILLNCSETETAVCNLGSINLVQHIVGDGLDEEKLSETISIAVRMLDNVIDINFYPTKEAKEANFAHRAIGLGVMGFQDALYKLDISYASQEAVEFADYSSELISYYAIQASCLLAKERGTYSSYKGSKWDRGLLPIDTIQLLANYRGEANLQMDTSSRKDWEPIRSLVKEHGMRHCQLMAIAPTATISNIIGVTQSIEPTYKHLFVKSNLSGEFTIPNVYLIEKLKKLGIWDADMLDDLKYFDGSLLEIERIPDHLKHIFLTAFEIEPEWIIECASRRQKWIDMGQSLNLYLAQPDGKKLSNMYLTAWKKGLKTTYYLRSSSATTVEKSFVDINKRGIQPRWMKNKSASAGIIVERAKKAPVCSLEEGCEACQ

SEQ ID NO: 584 - protein, 346 aa, C. Trachomatis D serovar
MQADILDGKQKRVNLNSKRLVNCNQVDVNQLVPIKYKWAWEHYLNGCANNWLPTEIPMGKDIELWKSDRLSEDERRVILLNLGFFSTAESLVGNNIVLAIFKHVTNPEARQYLLRQAFEEAVHTHTFLYICESLGLDEKEIFNAYNERAAIKAKDDFQMEITGKVLDPNFRTDSVEGLQEFVKNLVGYYIIMEGIFFYSGFVMILSFHRQNKMIGIGEQYQYILRDETIHLNFGIDLINGIKEENPEIWTPELQQEIVELIKRAVDLEIEYAQDCLPRGILGLRASMFIDYVQHIADRRLERIGLKPIYHTKNPFPWMSETIDLNKEKNFFETRVIEYQHAASLTW

SEQ ID NO: 585 - protein, 326 aa, C. Trachomatis D serovar
MSFFHTRKYKLILRGLLCLAGCFLMNSCSSSRGNQPADESIYVLSMNRMICDCVSRITGDRVKNIVLIDGAIDPHSYEMVKGDEDRMAMSQLIFCNGLGLEHSASLRKHLEGNPKVVDLGQRLLNKNCFDLLSEEGFPDPHIWTDMRVWGAAVKEMAAALIQQFPQYEEDFQKNADQILSEMEELDRWAARSLSTIPEKNRYLVTGHNAFSYFTRRYLSSDAERVSGEWRSRCISPEGLSPEAQISIRDIMRVVEYISANDVEVVFLEDTLNQDALRKIVSCSKSGQKIRLAKSPLYSDNVCDNYFSTFQHNVRTITEELGGTVLE

SEQ ID NO: 586 - protein, 102 aa, C. Trachomatis D serovar
MQNKRKVRDDFIKIVKDVKKDFPELDLKIRVNKEKVTFLNSPLELYHKSVSLILGLLQQIENSLGLFPDSPVLEKLEDNSLKLKKALIMLILSRKDMFSKAE

SEQ ID NO: 587 - protein, 243 aa, C. Trachomatis D serovar
VGCNLAQFLGKKVLLADLDPQSNLSSGLGASVRNNQKGLHDIVYKSNDLKSIICETKKDSVDLIPASFLSEQFRELDIHRGPSNNLKLFLNEYCAPFYDICIIDTPPSLGGLTKEAFVAGDKLIACLTPEPFSILGLQKIREFLSSVGKPEEEHILGIALSFWDDRNSTNQMYIDIIESIYKNKLFSTKIRRDISLSRSLLKEDSVANVYPNSRAAEDILKLTHEIANILHIEYERDYSQRTT

SEQ ID NO: 588 - protein, 527 aa, C. Trachomatis D serovar
MPSLSQSRRIIQQSSIRKIWNQIDTSPKHGVCVPLFSLYTQESCGIGEFLDLIPMIDWCISCGFQILQILPINDTGSCSSPYNSISSIALNPLHLSISALPYKEEVPAAETRIREMQQLSQLPQVHYEKVRSMKRDFFQEYYRVCKQKKLTDHPDFYAFCEQEKYWLHPYALFRSIREHLDNLPINHWPTTYTDLSQITEHERTFAEDIQFHSYLQYLCFQQMTQVREHANCKSCLIKGDIPILISKDSCDVWFYRHYFSSSESVGAPPDLYNAEGQNWHLPICNMKTLQQDNYLWWKERLRYAENFYSLYRLDHVVGLFRFWVWDESGCGRFEPHDPKNYLAQGQDILSHLLTSSSMLPIGEDLGTIPSDVKRMLESFAVCGTRIPRWERNWEGNGAYTPFDQYDPLSVTSLSTHDSSTLASWWKESPQESKLFAQFLGLPYSSTLSLHNHTEILKLSHKTSSIFRINLINDYLALFPDLISKTPRYERINLPGTISKNNWVYRVKPSIEDLSSHSKLNSLLEALF

SEQ ID NO: 589 - protein, 146 aa, C. Trachomatis D serovar
MQNQFEQLLTELGTQINSPLTPDSNNACIVRFGYNNVAVQIEEDGNSGFLVAGVMLGKLPENTFRQKIFKAALSINGSPQSNIKGTLGYGEISNQLYLCDRLNMTYLNGEKLARYLVLFSQHANIWMQSISKGALPDLHALGMYHL

SEQ ID NO: 590 - protein, 650 aa, C. Trachomatis D serovar
MTIPIHENKYSMISFTRTIGFRLWLICVAAIMFPLGINILQLNLQQYKKTLSSITSDLRENALFKAHTLQQTIPLNIDILALFSEIFDLDRGVPAEPDLALSKEMEKIFHSTYKEISLVKKEADGNFRVVASSRIEQLGKNYNQEIFLSDSQPFLATLRHSGSDSQVLAVLQTNIFDISSQEVLGVLYTLSDTNYLLNGLLAAKDPLSVKTAILSKNGIILQATDSSLDLVSIHKTVSKEQFCDVFLRDDICPPHLLLRPPLNLDPLPYGENFVSFCIGNTEMWGYIHSLPEMDFRILTYEEKSIIFASLWRRTLLYFAYFCCVLLGSITAFLVAKRLSKPIRKLATAMMETRRNQHHPYEPDSLGFEINHLGEIFNSMVQSLLQQQSLAEKNFEIKQHAQNALRLGEEAQQCLLPNQLPDSPTTEIAKAYIPAITVGGDFFDIFVIGEGPQAKLFLIVADASGKGVNACAYSLFLKNMLHTFLSELSSIQEAVQQTAALFYQQTAESGMFVTLCIYCYHYATRELEYYSCGHNPACLRAPNGDISFLSHPGMALGFLPEVPPHPAYTLVLEEESLLVLYTDGVTEASNKHGEMFGEERLKALVASLTKQSAEEAIQSIMFSIKSFVKDCPQHDDITLLVLKIPKEPSAY

SEQ ID NO: 591 - protein, 313 aa, C. Trachomatis D serovar
MLSYIKRRLLFNLLSLWVVVTLTFFIIKTIPGDPFNDENGNILSSETLALLKNRYGLDKPLFTQYLIYLKCLLTLDFGESLIYKDRTVISIIAAALPSSAILGLESLCLSLFGGITLGILAAFYKKSCGRTIFFSSVIQISVPAFVIGAFLQYVFAIKYSCLPIACWGNFSHTLLPSIALAITPMAFITQLTCASVSANLKKDYVLLAYAKGLSPFKVLIKHILPYALFPVISYSAFLITTLMTGTFSIENLFCIPGLGKWFICSIKQRDYPITLGLSVFYGAFFMLTSLCCDLLQAWIDPQIRYSYGKERSK

SEQ ID NO: 592 - protein, 1237 aa, C. Trachomatis D serovar
MTWIPLHCHSQYSILDATCSIKKFVAKAVEYQIPALALTDHGNLFGAVEFYKTCKQNAIKPIIGCELYVAPSSRFDKKKERKSRVANHLILLCKDEEGYRNLCLLSSLAYTEGFYYVPRIDRDLLSQHSKGLICLSACLSGSVAQAALESEEDLEKDLLWYQDLFQEDFFSEVQLHKSSEEKVALFEETWLKQNYYQFIEKQLKVNEAVLATSKRLGIPSVATNDIHYLNPDDWLAHEILLNVQSREPIRTAKQNTYIPNPKRKTYPSREFYFKSPQEIAELFAAHPETITNTCIVAERCHLELDFETKHYPIYVPEALQKKGSYTEEERYKASSAFLEELCEQGLTSKYTPELLGHIAKKFPGEDPLTLVKERLKLESSIIISKGMCDYLLIVWDIINWAKDHGIPVGPGRGSGAGSVMLFLLGITEIEPIRFDLFFERFINPERISYPDIDIDICMIGRERVINYAIERHGKDNVAQIITFGTMKAKMAIKDVGRTLDTPLAKVNFIAKHIPDLNATITSALEADPELRQLYVDDAEAAEVIDMAKKLEGSIRNTGVHAAGVIICGDPLTNHIPICVPKDSSMISTQYSMKPVESVGMLKVDFLGLKTLTGIHIATQAIYKKTGILLRAATIPLDDQNTFSLLHQGKTMGIFQMESRGMQDLAKNLRPDAFEEIIAIGALYRPGPMDMIPSFINRKHGKENIEYDHPLMEPILKETFGIMVYQEQVMQIAGSLAKYSLGEGDVLRRAMGKKDHEQMVKEREKFCSRAAANGIDPSIATTIFDKMEKFASYGFNKSHAAAYGLITYTTAYLKANYPKEWLAALLTCDYDDIEKVGKLIQEAHSMNILVLPPDINESGQDFEATQKGIRFSLGAVKGVGMSIVDSIVEEREKNGPYKSLQDFVQRADFKKVTKKQLENLVDAGTFDCFEPNKDLALAILNDLYDTFSREKKEAATGVLTFFSLDSMARDPVKITVSPENVIQRSPKELLKREKELLGVYLTAHPMDAVEHMLPFLSVVPARDFEGLPHGTIIRTVFLIDKVTTKISSAEQKKFALLQVSDEVDSYELPIWADMYAEYRDLLEEDRLIYAILAIDRRSDSLRLSCRWMRDLSTVNDSVIAECDEVYDRLKSQKVYSSTKKSTGAQSSAMIKKVETREISPVTISLDLNKLRHSHLFILKGLIRKYSGSQALSLVFTKDNQRFASISPDADFFVTDDISSLLQEIEATNIPARVLATTV

SEQ ID NO: 593 - protein, 563 aa, C. Trachomatis D serovar
MVYFRAHQPRHTPKTFPLEVHHSFSDKHPQIAKAMRITGIALAALSLLAVVACVIAVSAGGAAIPLAVISGIAVMSGLLSAATIICSAKKALAQRKQKQLEESLPLDNATEHVSYLTSDTSYFNQWESLGALNKQLSQIDLTIQAPEKKLLKEVLGSRYDSINHSIEEISDRFTKMLSLLRLREHFYRGEERYAPYLSPPLLNKNRLLTQITSNMIRMLPKSGGVFSLKANTLSHASRTLYTVLKVALSLGVLAGVAALIIFLPPSLPFIAVIGVSSLALGMASFLMIRGIKYLLEHSPLNRKQLAKDIQKTIGPDVLASMVHYQHQLLSHLHETLLDEAITARWSEPFFIEHANLKAKIEDLTKQYDILNAAFNKSLQQDEALRSQLEKRAYLFPIPNNDENAKTKESQLLDSENDSNSEFQEIINKGLEAANKRRADAKSKFYTEDETSDKIFSIWKPTKNLALEDLWRVHEACNEEQQALLLEDYMSYKTSECQAALQKVSQELKAAQKSFAVLEKHALDRSYESSVATMDLARANQETHRLLNILSELQQLAQYLLDNH

SEQ ID NO: 594 - protein, 1751 aa, C. Trachomatis D serovar; identical to SEQ ID NO: 445

SEQ ID NO: 595 - DNA, 900 bp, Chlamydia pneumoniae
atgctaaagattgatctaacaggaaaggtagcatttgttgcgggcattggtgatgaccaaggatatggctggggtattgctaaacttcttgcagaagcaggagctacgattattgtaggaacatgggtaccgatttacaaaattttctctcagtcttgggaattaggaaaattcaatgaatctagaaaattatcgaatggcactctcttagagattgctaagatctatcccatggacgcaagttttgatagccctgaagatgttcctgaagatattgctgaaaataaacgttacaagggcattacgggattcacgatatcagaagtcgcagaacaggtaaaaaaagattttggtcatattgacattcttgtccactcgctggcaaatagtcctgaaatttctaagtctctattagaaacatcaagaaaaggttacttagcggctctcagtgcctctagttattcttttgttagccttctctctcactttggaagtatcatgaaccgtggtggatcgacaatatcgctcacctatttggcttctatgcgcgctgttcctggatacggagggggcatgagttcggcaaaagcagctttggaaagtgacaccaaaactcttgcttgggaagcgggacgccgttggggcatacgtgtcaataccatctctgcaggacctttagcaagccgagctggaaaagcaattggttttattgaaagaatggtagactattaccaagagtgggcgcctattcccgaggctatgaatgccgagcaggtgggtgccgttgcagctttcttagcatcacctctagcttcagcaattactggtgagaccttatacgtagatcacggagccaatgtgatgggaattggtcctgagatgttccctaaagactcataa

SEQ ID NO: 596 - DNA, 1743 bp, Chlamydia pneumoniae
atgccaaaacaagctgaatatacttggggatctaaaaaaattctggacaatatagaatgcctcacagaagacgttgccgaatttaaagatttgctttatacggcacacagaattacttcgagcgaagaagaatctgataacgaaatacagcctggcgccatcctaaaaggtaccgtagttgatattaataaagactttgtcgtagttgatgttggtctgaagtctgagggagtgatccctatgtcagagttcatagactcttcagaaggtttagtgcttggagctgaagtagaagtctatctcgaccaagccgaagacgaagagggcaaagttgtcctttctagagaaaaagccacacgacaacgtcaatgggaatacatcttagctcattgtgaagaaggttctattgttaaaggtcaaattacacgtaaagtcaaaggcggccttattgtagatattggaatggaagccttcctacctggatcacaaattgacaacaagaaaatcaaaaatttagatgattatgtcggaaaagtttgtgaattcaaaattttaaaaattaacgttgaacgtcgcaatattgttgtctcaagaagagaactcttagaagctgagagaatctctaagaaagccgaacttattgaacaaatttctatcggagaataccgcaaaggagttgttaaaaacattactgactttggtgtattcttagatctcgatggtattgacggtcttctccacattaccgatatgacctggaagcgcatacgacatccttccgaaatggtcgaattgaatcaagagttggaagtaattattttaagcgtagataaagaaaaaggacgagttgctctaggtctcaaacaaaaagagcataatccttgggaagatattgagaagaaataccctcctggaaaacgagttcttggtaaaattgtgaagcttctcccctacggagctttcattgaaattgaagagggcattgaaggtctaattcacatttctgaaatgtcttgggtgaaaaatattgtagatcctagtgaagtcgtaaataaaggcgatgaagttgaagccattgttctatctattcagaaggacgaaggaaaaatttctctaggattaaagcaaacagaacgtaatccttgggacaatatcgaagaaaaatatcctataggtctccatgtcaatgctgaaatcaagaacttaaccaattacggtgctttcgttgaattagaaccaggaattgagggtctgattcatatttctgacatgagttggattaaaaaagtctctcacccttcagaactattcaaaaaaggaaattctgtagaggctgttattttatcagtagacaaagaaagtaaaaaaattactttaggagttaagcaattaagttctaatccttggaatgaaattgaagctatgttccctgctggcacagtaatttcaggagttgtgactaaaatcactgcatttggagcctttgttgagctacaaaacgggattgaaggattgattcacgtttcagaactttctgacaagccctttgcaaaaattgaagatattatctccattggagaaaatgtttctgcaaaagtaattaagctagatccagatcataaaaaagtttctctttctgtaaaagaatacttagctgacaatgcttatgatcaagactctaggactgaattagatttcaaggattctcaaggccctaaagagagaaagaaaaaaggaaaatag

SEQ ID NO: 597 - protein, 299 aa, Chlamydia pneumoniae
MLKIDLTGKVAFVAGIGDDQGYGWGIAKLLAEAGATIIVGTWVPIYKIFSQSWELGKFNESRKLSNGTLLEIAKIYPMDASFDSPEDVPEDIAENKRYKGITGFTISEVAEQVKKDFGHIDILVHSLANSPEISKSLLETSRKGYLAALSASSYSFVSLLSHFGSIMNRGGSTISLTYLASMRAVPGYGGGMSSAKAALESDTKTLAWEAGRRWGIRVNTISAGPLASRAGKAIGFIERMVDYYQEWAPIPEAMNAEQVGAVAAFLASPLASAITGETLYVDHGANVMGIGPEMFPKDS

SEQ ID NO: 598 - protein, 580 aa, Chlamydia pneumoniae
MPKQAEYTWGSKKILDNIECLTEDVAEFKDLLYTAHRITSSEEESDNEIQPGAILKGTVVDINKDFVVVDVGLKSEGVIPMSEFIDSSEGLVLGAEVEVYLDQAEDEEGKVVLSREKATRQRQWEYILAHCEEGSIVKGQITRKVKGGLIVDIGMEAFLPGSQIDNKKIKNLDDYVGKVCEFKILKINVERRNIVVSRRELLEAERISKKAELIEQISIGEYRKGVVKNITDFGVFLDLDGIDGLLHITDMTWKRIRHPSEMVELNQELEVIILSVDKEKGRVALGLKQKEHNPWEDIEKKYPPGKRVLGKIVKLLPYGAFIEIEEGIEGLIHISEMSWVKNIVDPSEVVNKGDEVEAIVLSIQKDEGKISLGLKQTERNPWDNIEEKYPIGLHVNAEIKNLTNYGAFVELEPGIEGLIHISDMSWIKKVSHPSELFKKGNSVEAVILSVDKESKKITLGVKQLSSNPWNEIEAMFPAGTVISGVVTKITAFGAFVELQNGIEGLIHVSELSDKPFAKIEDIISIGENVSAKVIKLDPDHKKVSLSVKEYLADNAYDQDSRTELDFKDSQGPKERKKKGK

SEQ ID NO: 599 - protein, 358 aa, Chlamydia trachomatis serovar D
MRKTVIVAMSGGVDSSVVAYLLKKQGEYNVVGLFMKNWGEQDENGECTATKDFRDVERIAEQLSIPYYTVSFSKEYKERVFSRFLREYANGYTPNPDVLCNREIKFDLLQKKVRELKGDFLATGHYCRGGADGTGLSRGIDPNKDQSYFLCGTPKDALSNVLFPLGGMYKTEVRRIAQEAGLATATKKDSTGICFIGKRPFKSFLEQFVADSPGDIIDFDTQQVVGRHEGAHYYTIGQRRGLNIGGMEKPCYVLSKNMEKNIVYIVRGEDHPLLYRQELLAKELNWFVPLQEPMICSAKVRYRSPDEKCSVYPLEDGTVKVIFDVPVKAVTPGQTVAFYQGDICLGGGVIEVPMIHQL

SEQ ID NO: 600 - DNA, 77 bp, Artificial Sequence
  Retroviral vector modified to contain Kozak translation inititation site and stop codons.
gatctgccgccaccatggaattcgatatcggatccctgcagaagcttgagctcgagcgcggccgctaattagctgag

SEQ ID NO: 601 - DNA, 77 bp, Artificial Sequence
  Retroviral vector modified to contain Kozak translation inititation site and stop codons.
acggcggtggtaccttaagctatagcctagggacgtcttcgaactcgagctcgcgccggcgattaatcgactcagct

SEQ ID NO: 602 - DNA, 78 bp, Artificial Sequence
  Retroviral vector modified to contain Kozak translation inititation site and stop codons.
gatctgccgccaccatgggaattcgatatcggatccctgcagaagcttgagctcgagcgcggccgctaattagctgag

SEQ ID NO: 603 - DNA, 78 bp, Artificial Sequence
  Retroviral vector modified to contain Kozak translation inititation site and stop codons.
acggcggtggtacccttaagctatagcctagggacgtcttcgaactcgagctcgcgccggcgattaatcgactcagct

SEQ ID NO: 604 - DNA, 79 bp, Artificial Sequence
  Retroviral vector modified to contain Kozak translation inititation site and stop codons.
gatctgccgccaccatggggaattcgatatcggatccctgcagaagcttgagctcgagcgcggccgctaattagctgag

SEQ ID NO: 605 - DNA, 79 bp, Artificial Sequence
  Retroviral vector modified to contain Kozak translation inititation site and stop codons.
acggcggtggtaccccttaagctatagcctagggacgtcttcgaactcgagctcgcgccggcgattaatcgactcagct

What is claimed:

1. An immunogenic composition comprising a pharmaceutically acceptable carrier and an isolated polypeptide, said polypeptide comprising:

(i) an amino acid sequence having at least 90% identity to the sequence encoded by SEQ ID No: 82, 86, 88, 114 or 407;

(ii) an immunogenic fragment of the amino acid sequence encoded by SEQ ID No: 82, 86, 88, 114 or 407;

(iii) an amino acid sequence having at least 90% identity to the sequence of SEQ ID No: 297 or 431; or (iv) an immunogenic fragment of the amino acid sequence of SEQ ID No: 297 or 431.

2. A composition according to claim 1, wherein the polypeptide comprises:

(i) an amino acid sequence having at least 90% identity to the sequence encoded by SEQ ID No: 82, 86, 88, 114 or 407; or (ii) an immunogenic fragment of the amino acid sequence encoded by SEQ ID No: 82, 86, 88, 114 or 407.

3. A composition according to claim 1, wherein the polypeptide comprises:

(i) an amino acid sequence having at least 90% identity to the sequence of SEQ ID No: 297 or 431; or (ii) an immunogenic fragment of the amino acid sequence of SEQ ID No: 297 or 431.

4. A composition according to claim 1, wherein the polypeptide consists of:

(i) an amino acid sequence having at least 90% identity to the sequence encoded by SEQ ID No: 82, 86, 88, 114 or 407;

(ii) an immunogenic fragment of the amino acid sequence encoded by SEQ ID No: 82, 86, 88, 114 or 407;

(iii) an amino acid sequence having at least 90% identity to the sequence of SEQ ID No: 297 or 431; or (iv) an immunogenic fragment of the amino acid sequence of SEQ ID No: 297 or 431.

5. A composition according to claim 4, wherein the polypeptide consists of:

(i) an amino acid sequence having at least 90% identity to the sequence encoded by SEQ ID No: 82, 86, 88, 114 or 407; or (ii) an immunogenic fragment of the amino acid sequence encoded by SEQ ID No: 82, 86, 88, 114 or 407.

6. A composition according to claim 4, wherein the polypeptide consists of:

(i) an amino acid sequence having at least 90% identity to the sequence of SEQ ID No: 297 or 431; or (ii) an immunogenic fragment of the amino acid sequence of SEQ ID No: 297 or 431.

7. A composition according to claim 1, wherein the polypeptide is a fusion protein.

8. A composition according to claim 7, wherein the fusion protein comprises:

(i) an amino acid sequence having at least 90% identity to the sequence encoded by SEQ ID No: 82, 86, 88, 114 or 407; or (ii) an immunogenic fragment of the amino acid sequence encoded by SEQ ID No: 82, 86, 88, 114 or 407.

9. A composition according to claim 7, wherein the fusion protein comprises:

(i) an amino acid sequence having at least 90% identity to the sequence of SEQ ID No: 297 or 431; or (ii) an immunogenic fragment of the amino acid sequence of SEQ ID No: 297 or 431.

10. An immunogenic composition comprising a immunostimulant and an isolated polypeptide, said polypeptide comprising:
(i) an amino acid sequence having at least 90% identity to the sequence encoded by SEQ ID No: 82, 86, 88, 114 or 407;
(ii) an immunogenic fragment of the amino acid sequence encoded by SEQ ID No: 82, 86, 88, 114 or 407;
(iii) an amino acid sequence having at least 90% identity to the sequence of SEQ ID No: 297 or 431; or
(iv) an immunogenic fragment of the amino acid sequence of SEQ ID No: 297 or 431.

11. A composition according to claim 10, wherein the polypeptide comprises:
(i) an amino acid sequence having at least 90% identity to the sequence encoded by SEQ ID No: 82, 86, 88, 114 or 407; or
(ii) an immunogenic fragment of the amino acid sequence encoded by SEQ ID No: 82, 86, 88, 114 or 407.

12. A composition according to claim 10, wherein the polypeptide comprises:
(i) an amino acid sequence having at least 90% identity to the sequence of SEQ ID No: 297 or 431; or
(ii) an immunogenic fragment of the amino acid sequence of SEQ ID No: 297 or 431.

13. A composition according to claim 10, wherein the polypeptide consists of:
(i) an amino acid sequence having at least 90% identity to the sequence encoded by SEQ ID No: 82, 86, 88, 114 or 407;
(ii) an immunogenic fragment of the amino acid sequence encoded by SEQ ID No: 82, 86, 88, 114 or 407;
(iii) an amino acid sequence having at least 90% identity to the sequence of SEQ ID No: 297 or 431; or
(iv) an immunogenic fragment of the amino acid sequence of SEQ ID No: 297 or 431.

14. A composition according to claim 13, wherein the polypeptide consists of:
(i) an amino acid sequence having at least 90% identity to the sequence encoded by SEQ ID No: 82, 86, 88, 114 or 407; or
(ii) an immunogenic fragment of the amino acid sequence encoded by SEQ ID No: 82, 86, 88, 114 or 407.

15. A composition according to claim 13, wherein the polypeptide consists of:
(i) an amino acid sequence having at least 90% identity to the sequence of SEQ ID No: 297 or 431; or
(ii) an immunogenic fragment of the amino acid sequence of SEQ ID No: 297 or 431.

16. A composition according to claim 10, wherein the polypeptide is a fusion protein.

17. A composition according to claim 16, wherein the fusion protein comprises:
(i) an amino acid sequence having at least 90% identity to the sequence encoded by SEQ ID No: 82, 86, 88, 114 or 407; or
(ii) an immunogenic fragment of the amino acid sequence encoded by SEQ ID No: 82, 86, 88, 114 or 407.

18. A composition according to claim 16, wherein the fusion protein comprises:
(i) an amino acid sequence having at least 90% identity to the sequence of SEQ ID No: 297 or 431; or
(ii) an immunogenic fragment of the amino acid sequence of SEQ ID No: 297 or 431.

19. A method of stimulating an immune response in a subject comprising administering to the subject an effective amount of a composition according to any one of claims 1 to 9 or 10 to 18.

20. A composition according to claim 10, wherein the immunostimulant is selected from the group consisting of lipid A, Bortadella pertussis or Mycobacterium tuberculosis derived proteins, Freund's Incomplete Adjuvant, Freund's Complete Adjuvant, Merck Adjuvant 65, AS-2, aluminum salts, aluminum hydroxide gel (alum), aluminum phosphate, salts of calcium, iron or zinc, insoluble suspensions of acylated tyrosine, acylated sugars, cationically or anionically derivatized polysaccharides, polyphosphazenes, biodegradable microspheres, monophosphoryl lipid A, quil A, cytokines, GM-CSF, interleukin-2, interleukin-7 and interleukin-12.

21. A composition according to claim 10, wherein the immunostimulant elicits a predominantly Th1-type immune response.

22. A composition according to claim 21, wherein the immunostimulant is selected from the group consisting of monophosphoryl lipid A, 3-de-O-acylated monophosphoryl lipid A, CpG-containing oligonucleotides, immunostimulatory DNA sequences, saponins and QS21.

23. A composition according to claim 21, wherein the immunostimulant comprises a combination of QS21 and 3-de-O-acylated monophosphoryl lipid A.

24. The composition of claim 3, wherein the polypeptide comprises an amino acid sequence having at least 90% identity to the sequence of SEQ ID No: 431, or an immunogenic fragment of the amino acid sequence of SEQ ID No: 431.

25. The composition of claim 6, wherein the polypeptide comprises an amino acid sequence having at least 90% identity to the sequence of SEQ ID No: 431, or an immunogenic fragment of the amino acid sequence of SEQ ID No: 431.

26. The composition of claim 9, wherein the polypeptide comprises an amino acid sequence having at least 90% identity to the sequence of SEQ ID No: 431, or an immunogenic fragment of the amino acid sequence of SEQ ID No: 431.

27. The composition of claim 12, wherein the polypeptide comprises an amino acid sequence having at least 90% identity to the sequence of SEQ ID No: 431, or an immunogenic fragment of the amino acid sequence of SEQ ID No: 431.

28. The composition of claim 15, wherein the polypeptide comprises an amino acid sequence having at least 90% identity to the sequence of SEQ ID No: 431, or an immunogenic fragment of the amino acid sequence of SEQ ID No: 431.

29. The composition of claim 18, wherein the polypeptide comprises an amino acid sequence having at least 90% identity to the sequence of SEQ ID No: 431, or an immunogenic fragment of the amino acid sequence of SEQ ID No: 431.

* * * * *